United States Patent
Zimmerman et al.

(10) Patent No.: US 10,179,164 B2
(45) Date of Patent: *Jan. 15, 2019

(54) METHOD FOR INDUCING AN IMMUNE RESPONSE FOR TREATMENT OF CANCER AND AUTOIMMUNE DISEASES OR CONDITIONS

(75) Inventors: Daniel H. Zimmerman, Bethesda, MD (US); Eyal Talor, Baltimore, MD (US); Kenneth Rosenthal, Akron, OH (US)

(73) Assignee: Cel-Sci Corporation, Vienna, VA (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/122,240

(22) PCT Filed: May 24, 2012

(86) PCT No.: PCT/US2012/039474
§ 371 (c)(1),
(2), (4) Date: May 30, 2014

(87) PCT Pub. No.: WO2012/162565
PCT Pub. Date: Nov. 29, 2012

(65) Prior Publication Data
US 2014/0286858 A1    Sep. 25, 2014

Related U.S. Application Data

(60) Provisional application No. 61/489,926, filed on May 25, 2011, provisional application No. 61/489,986, filed on May 25, 2011.

(51) Int. Cl.
| | |
|---|---|
| *A61K 38/00* | (2006.01) |
| *A61K 39/00* | (2006.01) |
| *A61K 38/16* | (2006.01) |
| *A61K 35/12* | (2015.01) |
| *A61K 51/02* | (2006.01) |
| *A61K 47/64* | (2017.01) |
| *A61K 47/68* | (2017.01) |
| *A61K 47/69* | (2017.01) |

(52) U.S. Cl.
CPC .............. *A61K 39/00* (2013.01); *A61K 35/12* (2013.01); *A61K 38/162* (2013.01); *A61K 39/0008* (2013.01); *A61K 39/0011* (2013.01); *A61K 47/646* (2017.08); *A61K 47/68* (2017.08); *A61K 47/6901* (2017.08); *A61K 51/02* (2013.01); *A61K 2039/5154* (2013.01)

(58) Field of Classification Search
None
See application file for complete search history.

(56) References Cited

U.S. PATENT DOCUMENTS

| | | | |
|---|---|---|---|
| 6,572,860 B1 * | 6/2003 | Zimmerman et al. | ..... 424/194.1 |
| 2006/0257420 A1 | 11/2006 | Zimmerman | |
| 2007/0128698 A1 | 6/2007 | Talor | |
| 2011/0098444 A1 | 4/2011 | Zimmerman | |

FOREIGN PATENT DOCUMENTS

| | | | | |
|---|---|---|---|---|
| WO | WO2008043157 | | 4/2008 | |
| WO | WO 2009114869 A2 * | | 9/2009 | ......... C07K 14/7055 |
| WO | 2010120897 A1 | | 10/2010 | |
| WO | WO2013138871 A1 | | 9/2013 | |

OTHER PUBLICATIONS

Bauer et al., "Maximizing Immune Responses: The Effect of Covalent Peptide Linkage to Beta-2-Microglobulin", Oncology Research, 2008, pp. 205-216.*
Zhang et al., "GABAergic signaling facilitates breast cancer metastasis by promoting ERK1/2-dependent phosphorylation", Cancer Letters, 2014, pp. 100-108.*
Benham, Citrullinated peptide dendritic cell immunotherapy in LA risk genotype—positive rheumatoid arthritis patients, Rheumatoid Arthritis, vol. 7, issue 290, pp. 1-12.
U.S. Appl. No. 60/853,814.

* cited by examiner

*Primary Examiner* — Lianko G Garyu
(74) *Attorney, Agent, or Firm* — Hahn & Associates PLLC; Roger C. Hahn

(57) ABSTRACT

The invention is related to peptide constructs, i.e., polypeptides obtained by linking together two or more peptides based on or derived from different molecules, which are useful in the treatment or prevention of cancer or the treatment of autoimmune diseases and compositions containing same, methods for producing same, and methods for using same; wherein the peptide constructs have the formula $P_1$-x-$P_2$ where $P_2$ is a peptide associated with forms of cancer or an autoimmune condition and $P_1$ is a peptide which will bind to a class of immune cells such as dendritic cells. The peptide construct can cause the maturation of immature dendritic cells to a more mature state. The peptide construct or the more mature dendritic cells can be administered to a subject to a modulate or to initiate an immune response against cancer cells, and can be used with dyes, radioisotopes, or therapeutic agents for detection of the immune target and/or treatment of cancer and autoimmune conditions.

22 Claims, 4 Drawing Sheets
Specification includes a Sequence Listing.

METHOD FOR INDUCING AN IMMUNE RESPONSE FOR TREATMENT OF CANCER AND AUTOIMMUNE DISEASES OR CONDITIONS

SEQUENCE LISTING

This application contains a "Sequence Listing" submitted as an electronic .txt file named "CS_ST25.txt." The subject matter of the "Sequence Listing" is incorporated herein by reference along with the subject matter of U.S. patent application Ser. Nos. 12/992,687, 11/443,314, 61/489,926 and 61/489,986, U.S. Pat. Nos. 6,995,237 and 7,256,254, and International Published Patent Application WO 2010/120897 A1 (PCT/US2010/031054).

FIELD OF INVENTION

The invention generally related to methods and compositions for activating and promoting the maturation of immature dendritic cells or monocytes into matured dendritic cells (DCs) and eliciting favorable properties in the matured dendritic cells.

BACKGROUND

Autoimmune conditions are characterized by the body attacking itself by mounting an immune response against self antigens to which it is normally tolerant. As such, approaches to treating autoimmune conditions, have focused on down regulating the "inappropriate" immune response against self. However, many approaches to treating autoimmune and like conditions are not specific to down regulating the immune system's response to a specific antigen. Rather, therapies focus on a general suppression of the immune system. Similarly, cancer can be characterized by increased expression of self oncogenes that are not adequately recognized by the immune system. As such, adjustment of the regulation of the immune system in regards to the identification of self antigens can be used to address both autoimmune conditions and cancer.

Some of these less antigen specific approaches utilize monoclonal antibodies that act on activated T cells and down regulate them such as by anti-CD3 (Protein Design Laboratories) or block APC and T cell interaction by anti-ICAM-3 (ICOS). MEDI-507 (Medimmune) is believed to be a humanized monoclonal antibody, for psoriasis that also targets CD2, presumably for removing or inactivating those cell types. Other diseases, such as, tissue transplantation rejection and allergies are also being tested by this approach. In contrast to acting on cell surface markers, rhu-mAB-E25 (Genentech) is believed to be a humanized monoclonal antibody against IgE that binds to circulating IgE, with the goal of preventing activation of mast cells. In contrast, other researchers are developing monoclonal antibodies to act on symptoms or agents directly causing disease symptoms. Remicade Infliximab (Centocor™) is purported to be a monoclonal antibody to TNF. Anti CD40 ligand has been used for treatment in animal model of multiple sclerosis (MS) (L. M. Howard, et al., 1999, J. Clin. Invest, 103:281). A recombinant generated designed protein Enbrel (Immunex™) is purported to comprise two molecules of r-DNA derived TNF receptor, and is intended to block TNF's action.

It should be noted, however, that many of these agents are not sufficiently disease specific and often recognize and could affect normal cellular and body constituents that have a defined and necessary role in normal immune defenses which are still needed.

Some more antigen or disease specific approaches are exemplified by the attempt to treat MS patients by oral administration of myelin proteins which have recently been reported; the same group of researchers is also using collagen type II for treatment of patients with rheumatoid arthritis. These treatments are designed to attack at the level of the gut associated lymphoid tissues (GALT) to induce tolerance by antigen specific suppression of the immune system. It is not know if these treatments use the intact protein or a hydrolyzate containing smaller peptides. See D. Hafler, et al. 1988, J. Immunol., 141:181; K. Wucherpfennig, et. al. 1990, Science, 248:1016; K. Ota, et al., 1990, Nature, 346:183; and H. Weiner, 1999, PNAS, 88:9161.

Several researchers are testing peptide based materials for treatment of autoimmune conditions. One approach uses peptide as immunogen, given orally in large quantities. The peptide represents a peptide sequence that is though to be the autoimmune epitope itself or a modified form which may also have altered binding or improved stability properties. By use of the peptide it is thought that either the normal peptide or an altered peptide ligand (APL) will bind to the T cell receptor (TCR) and induce a state of anergy since the multiple sets of bindings that would occur with antigen presentation with an antigen presenting cell (APC) do not occur (A. Faith, et al., 1999, J. Immunol., 162:1836; Soares, et al. 1998, J. Immunol., 160:4768; M. Croft, et al. 1997, J. Immunol., 159:3257; L. Ding, et al., 1998, J. Immunol., 161:6614; and S. Hin, et al. 1999, J. Immunol., 163:2363). Some of the approaches with APL include using related amino acids such a D amino acids (U. Koch, et al. 1998, J. Immunol., 161:421), amino acids with substituted side chains (R. DePalma et al. 1999, J. Immunol., 162:1982), methylene groups to replace peptide bonds in the peptide backbone (L. Meda, et al., 1996, J. Immunol., 157:1213) and N-hydroxyl peptides (S. Hin et al. J. Immunol., 163:2363).

The more antigen-specific approaches outlined above rely on using large amounts of antigens to desensitize a subject to the antigen. The possible drawbacks and consequences of the administration of large quantities of antigen include further undesirable and unpredictable immune responses. Peptide-based immunomodulators have the possible advantage of being a well-defined immunogen that would facilitate the generation of a safe and predictable response. However, safety is maximized by the use of small quantities of immunomodulators targeted to specific immune cells instead of the use of large quantities of an antigen introduced into the patient.

Few therapeutics are available as recombinant proteins that can modulate the immune system in active and antigen-specific capacity. Viral vector vaccines have been attempted to promote antigen-specific immunomodulation. However, problems are also associated with viral vector vaccines. One problem is the immune response induced against the vector itself. This induced immune response severely limits the number and frequency of subsequent injections/boosters that can be administered. Moreover, some adenoviruses have the potential for causing allergic conditions such as celiac disease. It is also known that many viral proteins, including some from HIV and HSV contain immunosuppressive epitopes. Viral proteins are also suspected as causative agents for other autoimmune conditions such as type 1 diabetes. Multiple Sclerosis (MS), Myocarditis, and Graves disease.

Another disadvantage in using a DNA-based or viral vector vaccines, including for autoimmune conditions, is the possibility of the vaccine DNA being integrated into the host's genome. One alternative is to conjugate a particular epitope to a carrier protein to avoid such incorporation into the genome. It is known within the art to use large carrier proteins such as Keyhole Limpet Hemocyanin (KLH), Bovine Serum Albumin (BSA), or Antigenics' heat shock proteins (HSP) couple/conjugated or incorporated with a virus protein.

Other options for peptide delivery of peptide epitopes include the use of synthetic biodegradable microparticles like Poly(lactide-co-glycolide) PLG with aggregated antigen. Still other delivery technologies for peptide antigens include AutoVac™ of Pharmexa. Other small molecule delivery technologies for peptides are Antigen Express's 'li-key' delivery, phage display and Multiple Antigen Presentation (MAPS) technologies (Rosenthal 2005 Immune peptide enhancement of peptide based vaccines Frontiers in Bioscience 1:478:482).

Many of the known approaches have the major disadvantage of using large, very immunogenic carriers. Moreover, patient populations requiring such therapeutics have usually been exposed to many of these same antigens during their lifetimes. Hence, and similar to vaccine vector delivery of antigens, clearance of the antigen can be so vigorous in the previously exposed host that no response will occur to the new antigen. On the other hand, a strong immune response may occur upon reintroduction of the vector. For example, in the case of the conjugate VP22 containing HSV-1 protein, the response may be undesirable given that a majority of adults have had one or more exposures to HSV-1 (Muranyiova et al. 1991 Immunoprecipitation of herpes simplex virus polypeptides with human sera is related to their ELISA titre. Acta Virol, 35:252-9).

In regards to immune-based cancer therapies, cancer can have many causes that result in the uncontrolled growth of cells. One cause of cancers is the mutation or increased expression of oncogenes in cancerous cells. Oncogenes, like all genes, function to code for a protein that is synthesized by the cell. Often, cancers are caused by a DNA mutation that alters the regulation of expression of the oncogene or oncofetal gene or a DNA mutation that causes a change in the amino acid sequence of the oncogene itself. The alteration of regulation of an oncogene or oncofetal gene or a mutation in an oncogene or oncofetal can also affect the expression of other proteins in a cancerous cell. Cancerous cells can, therefore, have different levels of protein expression compared with surrounding healthy tissue. A change in the level of protein expression or the expression of mutated proteins on the surface of cancerous can be used by the immune system to direct an immune response to cancerous cells.

The proteins expressed on the surface of a cancerous cell can act as antigens for an immune response. However, most of the proteins expressed on the surface of cancerous cells are non-mutated self-antigens. Self antigens are usually ineffective in triggering an immune response since they are present in healthy as well as cancerous cells. Even in situations where a cancer cell is expressing a mutated protein, antigenic changes in cancerous cells that are created by individual point mutations may be too subtle from the standpoint of the immune system to trigger a significant immune response. Since cancer cells utilize essentially the same cellular proteins as healthy cells, cancer cells can often grow and survive without generating an anti-cancer immune response.

Peptides can have sufficient structure to be recognized with specificity by immunoproteins, such as antibodies, and by immune cells. That is, short peptides having from about 8 to about 30 amino acid residues have sufficient structure to bind to antibodies and serve as an antigen, epitope or other ligand for proteins involved in the activation of the immune system. However, short peptides often generate no or only a weak immune response when administered alone to a human or animal subject. Often, it is necessary to link or to introduce short peptides with larger proteins or biomolecules to serve as a carrier or an adjuvant to induce an immune response that will generate antibodies specific to the short peptide and to initiate an immune response to these short peptides.

There is a need for peptide-based immunomodulators having a well-defined immunogen to treat cancer that facilitates the generation of a safe and predictable anti-tumor response rather than a mixed response including an immune response to a carrier. There is also a need for the development of peptide-based immunomodulators, and the related need for the identification of peptides capable of being recognized by specific components of the immune systems and generating a specific type of directed immune response.

SUMMARY OF THE INVENTION

The peptide constructs disclosed herein are based on a Ligand Epitope Antigen Presentation System (LEAPS™) which can convert small peptides, which typically do not exhibit a strong effect on the immune system into antigen specific immunomodulators. The immunomodulators disclosed herein have the ability to promote the differentiation of immature dendritic cells (DCs) to matured DCs that are educated or competent to affect other components of the immune system with respect to specific antigens. The immunogens disclosed herein promote the upregulation of CD11c, CD86 and Major Histocompatibility Complex class II (MHC II) in immature DCs isolated or generated from bone marrow cells, which are phenotypical indications of matured DCs. The matured DCs have an increased production of IL-12, particularly IL-12p70, indicated matured DCs that are competent to signal a TH1-type immune response.

Upon administration to a subject, DCs matured with the immunomodulator disclosed herein have the capability to locate to a site in the subjects body harboring a source of the antigen to which an autoimmune response is directed. In certain embodiments, the administered matured DCs have the ability to modulate an immune response to an autoimmune antigen.

In certain embodiments, DCs matured with the immunomodulators disclosed herein have an ability to locate or "target" to a site in the subject's body harboring a source of the antigen and/or the site of an autoimmune condition. The DCs matured with the immunomodulators can be used to diagnose or determine the presence or location in the body of an autoimmune response in a subject to which the matured DCs are administered. The immunomodulators can be conjugated with a radionuclide (including $^{18}F$, $^{32}P$, $^{64}Cu$, $^{90}Y$, $^{99m}Tc$, $^{131}I$, $^{125}I$, $^{124}I$, $^{80}Zr$, $^{111}In$, $^{188}Re$, or $^{177}Lu$) that co-locate with the matured DCs. The location of the matured DCs can then be determined through appropriate radiation-detection techniques to diagnose the presence and/or location of an autoimmune condition in the body of the subject.

In certain embodiments, the matured DCs are conjugated or associated with a radionuclide (including $^{18}F$, $^{32}P$, $^{64}Cu$, $^{90}Y$, $^{99m}Tc$, $^{131}I$, $^{125}I$, $^{124}I$, $^{89}Zr$, $^{111}In$, $^{188}Re$, or $^{177}Lu$) that locates to the location of an autoimmune or other undesirable immune response in the body of a subject to which the matured DCs are administered. The radionucleotide can be conjugated to an antibody (mAb) to CD11c or MHC II located on the surface of the matured DCs. In the alternative, an antibody can have specificity to other cell surface markers including DEC-205, Dectin-1, DC-SIGN, and DC-LAMP. In certain embodiments, an mAb binds to markers on the surface of DCs such that the binding of the mAb to the DCs does not alter the activation or changes induced by the peptide construct heteroconjugates described herein.

In certain embodiments, radiation from radioisotopes can be used for detection by X-ray sensitive films or instruments or related technologies. The compositions of the invention can be detected by single-photon emission tomography/computed tomography (SPECT/CT), and $^{99}Tc$, $^{201}Ti$ and $^{89}Zr$ can be used to generate photon emission tomography (PET) images. Sources of radiation can be conjugated to the immunomodulator peptide used to mature the DCs or can be conjugated to an mAb having specificity for the matured DCs.

In certain embodiments, the matured DCs can be conjugated or associated with a therapeutic agent. The therapeutic agent can co-locate to the site of an autoimmune or other undesirable immune response together with matured DCs administered to a subject.

In certain embodiments, the matured DCs can be conjugated or associated with a dye agent. The dye agent can co-locate to the site of an autoimmune or other undesirable immune response to allow for the diagnostic detection or imaging of the site.

In certain embodiments, a composition comprising a population of matured dendritic cells is provided. The population of matured dendritic cells is formed by treating immature dendritic cells of monocytes with an effective amount of a peptide construct serving as an immunomodulator having the formula $P_1$-x-$P_2$ or $P_2$-x-$P_1$ under conditions suitable for maturation of the cells to form the matured or effective dendritic cells which interacts with T cells, where $P_2$ represents a specific antigenic peptide derived from an autoimmune antigen, $P_1$ represents an immunomodulatory peptide which is a portion of an immunoprotein capable of promoting binding to a class or subclass of DC cells, and -x- represents a covalent bond or a divalent linking group.

In certain embodiments, a method for targeting matured or effective dendritic cells to a site of an autoimmune condition in a subject is provided. Immature dendritic cells or monocytes are treated with a peptide construct immunomodulator ex vivo under conditions suitable for maturation of the cells to form more matured or activated dendritic cells, and an effective amount of these matured dendritic cells are administered to the subject, wherein a majority of the dendritic cells administered to the subject locate to the site of an autoimmune or other undesirable immune response.

Upon administration to a subject, DCs matured ex vivo with the immunogens disclosed herein have the capability to locate to a site in the subjects body harboring a source of the antigen contained in the immunogen such as a cancer tumor, a cluster of cancer cells or any other antigen source. In certain embodiments, the administered matured DCs have the ability to direct an immune response against a source of the antigen, such as cancer cells, such that the subject's immune system can be modulated to kill cancer cells.

In certain embodiments, DCs matured with the immunogens disclosed herein have an ability to locate or "target" to a site in the subject's body harboring a source of the antigen contained in the immunogen such as a cancer tumor, a cluster of cancer cells or any other antigen source. The ability of DCs matured with the immunogens can be used to diagnose or determine the presence of cancer cells or other sources of antigens in the body of a subject to which the matured DCs are administered. The immunogens can be conjugated with a therapeutic agent or a radionuclide (including $^{18}P$, $^{32}P$, $^{64}Cu$, $^{90}Y$, $^{99m}Tc$, $^{131}I$, $^{125}I$, $^{124}I$, $^{111}In$, $^{188}Re$, or $^{177}Lu$) that co-locate the matured DCs. The location of the matured DCs can then be determined through appropriate radiation-detection techniques to diagnose the presence and/or location of cancer cells or other sources of antigens in the body of the subject.

In certain embodiments, the matured DCs are conjugated or associated with a radionuclide (including $^{18}F$, $^{32}P$, $^{64}Cu$, $^{90}Y$, $^{99m}Tc$, $^{131}I$, $^{125}I$, $^{124}I$, $^{89}Zr$, $^{111}In$, $^{188}Re$, or $^{177}Lu$) that locates to the location of cancer cells or other sources of antigens in the body of a subject to which the matured DCs are administered. The radionuclide can be conjugated to an antibody (Mab) to CD11c or CD3 located on the surface of the matured DCs.

In certain embodiments, the matured DCs is conjugated or associated with a radionuclide that is a source of ionizing radiation. Examples of sources of ionizing radiation include high-energy β-emitters, such as certain isotopes of yttrium or rhenium, α-emitters or position emission such as $^{64}Cu$, $^{124}I$ and certain isotopes of bismuth or astatine. Matured DCs conjugated or associated with sources of ionizing radiation are used to deliver the ionization radiation primarily at the site of cancer cells or other source of antigen where the antigen is being expressed due to the location of the matured DCs to the site cancer cells or other sources of antigen. High-energy and short half-life gamma emitters can be used for detection of X-ray sensitive films or instruments or related technologies. $^{111}In$ can be detected by single-photon emission tomography/computed tomography (SPECT/CT), and $^{99}Tc$, $^{201}Ti$ and $^{89}Zr$ can be used to generate photon emission tomography (PET) images. Sources of ionizing radiation can be conjugated to immunogen used to mature the DCs or can be conjugated to an mAb having specificity for the matured DCs.

In certain embodiments, the matured DCs are conjugated or associated with a therapeutic agent which can be cytotoxic or other drug or toxin or cytokine with preferential toxicity to cancerous cells. The therapeutic agent can co-locate to the site cancer cells or other sources of antigen together with matured DCs administered to a subject.

In certain embodiments, the matured DCs are conjugated or associated with a dye (e.g., fluorescent or luminescent) agent. The dye agent can co-locate to the site of cancer cells or other sources of antigen together with matured DCs administered to a subject and allow for the diagnostic detection or imaging of cancer cells or other sources of antigen.

In certain embodiments, the LEAPS matured DCs are conjugated or associated with a monoclonal antibody or lectin which reacts or binds with the surface of the DC (such as CD11c, MHC II or other potential DC markers such as DEC-205. Dectin-1, DC-SIGN, DC-LAMP) in a manner that does not alter the response on the LEAPS activated DC and further this Monoclonal antibody can be conjugated or associated with a radioactive nucleotide, drug (cytotoxic drug or other cancer treating drug), toxin, cytokine or staphylococcus endotoxin A or B (SHE or SEB) or a dye (e.g., fluorescent or luminescent) agent.

In certain embodiments, a composition has a population of matured dendritic cells is provided. The population of matured dendritic cells is formed by treating immature dendritic cells or monocytes with an effective amount of a peptide construct having the formula $P_1$-x-$P_2$ or $P_2$-x-$P_1$ under conditions suitable for maturation of the cells to form the matured or effective dendritic cells which interacts with T cells, where $P_2$ represents a specific antigenic peptide derived from a cancer cell. $P_1$ represents an immunomodulatory peptide which is a portion of an immunoprotein capable of promoting binding to a class or subclass of DC cells, and -x- represents a covalent bond or a divalent linking group.

A method for targeting matured or effective dendritic cells to a site of cancer cells in a subject is provided. Immature dendritic cells of monocytes are treated with a peptide construct ex vivo under conditions suitable for maturation of the cells to form more matured or activated dendritic cells, and an effective amount of these matured dendritic cells are administered to the subject, wherein a majority of the dendritic cells administered to the subject locate to the site of cancer cells.

In certain embodiments, a peptide for directing an immune response in an autoimmune condition or to cancer or for maturing dendritic cells is a peptide construct selected from the group consisting of SEQ ID No.'s 291, 293, 315, 317, 319, 325, 331, 339, 341, 347, 355, 782, 786, 804, 828, 856-866, 867-879, 881, 883-884, 886-895, 897, 899-904, 906-916, 964-996, and 1045-1090 or a variant thereof.

In certain embodiments, a composition containing matured dendritic cells is provided. The matured dendritic cells are formed by contacting immature dendritic cells or monocytes with an effective amount of a peptide construct having the formula $P_1$-x-$P_2$ or $P_2$-x-$P_1$ under conditions suitable for maturation of the immature dendritic cells to form the matured dendritic cells, wherein $P_2$ represents a peptide derived from a cancer cell or derived from a protein involved in an autoimmune disease competent for recognition by a class or subclass or immune cells or binding to an antibody: $P_1$ represents an immunomodulatory peptide which is a portion of an immunoprotein capable of promoting binding to a class or subclass of dendritic cells; and x represents a covalent bond or a divalent linking group.

In certain embodiments, a composition containing a population of matured dendritic cells is provided. The matured dendritic cells formed are by contacting immature dendritic cells or monocytes with an effective amount of a peptide construct selected from the group consisting of SEQ ID No.'s 291, 293, 315, 317, 319, 325, 331, 339, 341, 347, 355, 782, 786, 804, 828, 856-866, 867-879, 881, 883-884, 886-895, 897, 899-904, 906-916, 964-966, and 1045-1090 or a variant thereof under conditions suitable for maturation of the dendritic cells of monocytes.

In certain embodiments, a method for modulating an immune response in an autoimmune disease or condition or to cancer includes administering an immunologically effective amount of a peptide construct selected from the group consisting of SEQ ID No.'s 291, 293, 315, 317, 319, 325, 331, 339, 341, 347, 355, 782, 786, 804, 828, 856-866, 867-879, 881, 883-884, 886-895, 897, 899-904, 906-916, 964-966, and 1045-1090 or a variant thereof or a variant thereof to a subject.

In certain embodiments, a method for producing a matured dendritic cell population is performed by contacting or treating immature dendritic cells or monocytes with an effective amount of a peptide construct having the formula $P_1$—X—$P_2$ or $P_2$—X—$P_1$ under conditions suitable for maturation of dendritic cells or monocytes to form matured dendritic cells, wherein $P_2$ represents a peptide derived from a cancer cell or derived from a protein involved in an autoimmune disease competent for recognition by a class or subclass of immune cells or binding to an antibody: $P_1$ represents an immunomodulatory peptide which is a protein of an immunoprotein capable of promoting binding to a class or subclass of dendritic cells; and x represents a covalent bond or a divalent peptide linking group.

In certain embodiments, a tracking marker or a therapeutic agent is conjugated to an antibody having affinity for any one of MHC II, CD11c, DEC-205, Dectin-1, DC-SIGN, and DC-LAMP.

In certain embodiments, matured dendritic cells exhibit an upregulation of one or more of CD80, CD86 and Major Histocompatibility Complex II relative to immature dendritic cells or monocytes not contacted with the peptide construct.

In certain embodiments, matured dendritic cells are isolated away from bone marrow or blood tissues.

In certain embodiments, matured dendritic cells produce an increased amount of Interleukin 12p70 (IL-12p70) compared to immature dendritic cells or monocytes not contacted with the peptide construct.

In certain embodiments, a therapeutic agent or a tracking marker is conjugated to a peptide conjugate the peptide construct is conjugated to the therapeutic agent by a cathepsin cleavable valine-citrulline dipeptide linker or by linking with a cysteine or lysine residue of the peptide construct by conjugation to a group selected from OH groups, COOH groups, amine groups, and amide groups of the peptide construct.

In certain embodiments, a peptide construct is conjugated to a lysomatropic agent.

In certain embodiments, an immune response in a subject is modulated in response to an autoimmune disease or condition or against cancer by contracting immature dendritic cells or monocytes with a peptide construct having the formula $P_1$-x-$P_2$ or $P_2$-x-$P_1$ under conditions suitable for maturation of the cells to form matured dendritic cells and administering an effective amount of the matured dendritic cells to the subject. In the peptide construct, $P_2$ represents a peptide derived from a cancer cell or derived from a protein involved in an autoimmune disease competent for recognition by a class or subclass of immune cells or binding to an antibody: $P_1$ represents an immunomodulatory peptide which is a portion of an immunoprotein capable of promoting binding to a class or subclass of dendritic cells; and x represents a covalent bond or a divalent peptide linking group.

In certain embodiments, the peptide construct having the formula $P_1$-x-$P_2$ or $P_2$-x-$P_1$ has a peptide $P_1$ selected from the group consisting of SEQ ID No.'s 4-6, 13, 15, 27, 48 and 49 or variants thereof.

In certain embodiments, the peptide construct having the formula $P_1$-x-$P_2$ has a peptide $P_2$ selected from one of the following groups; the group consisting of SEQ ID No.'s 51, 53, 55 and 960-961; SEQ ID No.'s SEQ ID No.'s 51, 53, 55 and 960-961; the group consisting of SEQ ID No.'s 72, 749, 751, 753, 755 and 917; the group consisting of SEQ ID No.'s 74, 76, 78, 80, 82, 84, 86, 88, 90, 92, 98, 103, 449, 452, 469, 918, 957 and 958; the group consisting of SEQ ID No.'s 1, 474, 477, 482, 487, 490, 493 and 812 and 962-963; SEQ ID No.'s 496, 499, 919, 920, 921, and 922; the group consisting of SEQ ID No.'s 2, 524, 527, 549, 552, 555, 572, 581, 588, 597, 606, 609, 612, 623, 636, 641, 924, 925, 950 and 959; SEQ ID No.'s 653 and 664; the group consisting of SEQ ID No.'s 3 and 927; SEQ ID No. 774; the group consisting of SEQ ID No.'s 19, 737, 738, 951; SEQ ID No.'s 928 and 947; the group consisting of SEQ ID No.'s 929 and 948; the group consisting of SEQ ID No.'s 930936 and 949; the group consisting of SEQ ID No.'s 937-940; the group consisting of SEQ ID No.'s 941-942; the group consisting of SEQ ID No.'s 943-944; and the group consisting of SEQ ID No.'s 945-946, or variants of any of the foregoing sequences.

In certain embodiments, the peptide construct having the formula $P_1$-x-$P_2$ has a peptide $P_2$ selected from one of the following groups; the group consisting of SEQ ID No.'s 967-969 and 1013-1014; the group consisting of SEQ ID No.'s 973-978 and 1016-1021; the group consisting of SEQ ID No.'s 979-980 and 1022-1023; the group consisting of SEQ ID No.'s 981-988 1024-1031; the group consisting of SEQ ID No.'s 989-990 and 1032-1033; the group consisting of SEQ ID No.'s 991-995 and 1034-1035; the group consisting of SEQ ID No.'s 996-999 and 1036-1039; the group consisting of SEQ ID No.'s 1000-1006 and 1040-1043; the group consisting of SEQ ID No.'s 1007-1011 and the group consisting of SEQ ID No.'s 1012 and 1044), or variants of any of the foregoing sequences.

In certain embodiments, the peptide construct is selected from one of the following groups: the group consisting of SEQ ID No.'s SEQ ID No.'s 291, 293, 856 and 964-965 SEQ ID No.'s 857-861; the group consisting SEQ ID No.'s 315, 317, 319, 325, 331, 339, 341, 862 and 863-870; SEQ ID No.'s 347, 828, 871-876 and 966; the group consisting SEQ ID No.'s 781, 877, 878, 879; SEQ ID No.'s 881, 883-884, 886-895, 897 and 899-900; SEQ ID No.'s 786 and 901; SEQ ID No. 902; the group consisting SEQ ID No.'s 355, 903 and 904; SEQ ID No. 804; SEQ ID No. 906; SEQ ID No. 907; the group consisting SEQ ID No.'s 908-911; the group consisting SEQ ID No.'s 912-913; the group consisting SEQ ID No. 914; SEQ ID No. 915 and SEQ ID No. 916, or variants of any of the foregoing sequences.

In certain embodiments, the peptide construct is selected from one of the following groups; the group consisting of SEQ ID No.'s 1045-1049; the group consisting of SEQ ID No.'s 1051-1056; the group consisting of SEQ ID No.'s 1057-1058; the group consisting SEQ ID No.'s 1059-1066; SEQ ID No.'s 1067-1068; the group consisting SEQ ID No.'s 1069-1073; the group consisting SEQ ID No.'s 1074-1077; the group consisting SEQ ID No.'s 1078-1084; SEQ ID No.'s 1085-1089; SEQ ID No. 1050 and SEQ ID No. 1090.

One of ordinary skill in the art will appreciate that other aspects of this invention will become apparent upon review of the following detailed description.

BRIEF DESCRIPTION OF THE DRAWINGS

In FIG. 1A, cells from 3 mice were then stained with PE-anti-CD11c and in FIG. 1B, PE-anti-CD86, and flow cytometry was performed on cells within the suspension with light scatter parameters of monocytes. The X-mean for each evaluation indicates extent of antigen expression.

DETAILED DESCRIPTION OF THE INVENTION

Figure 1:
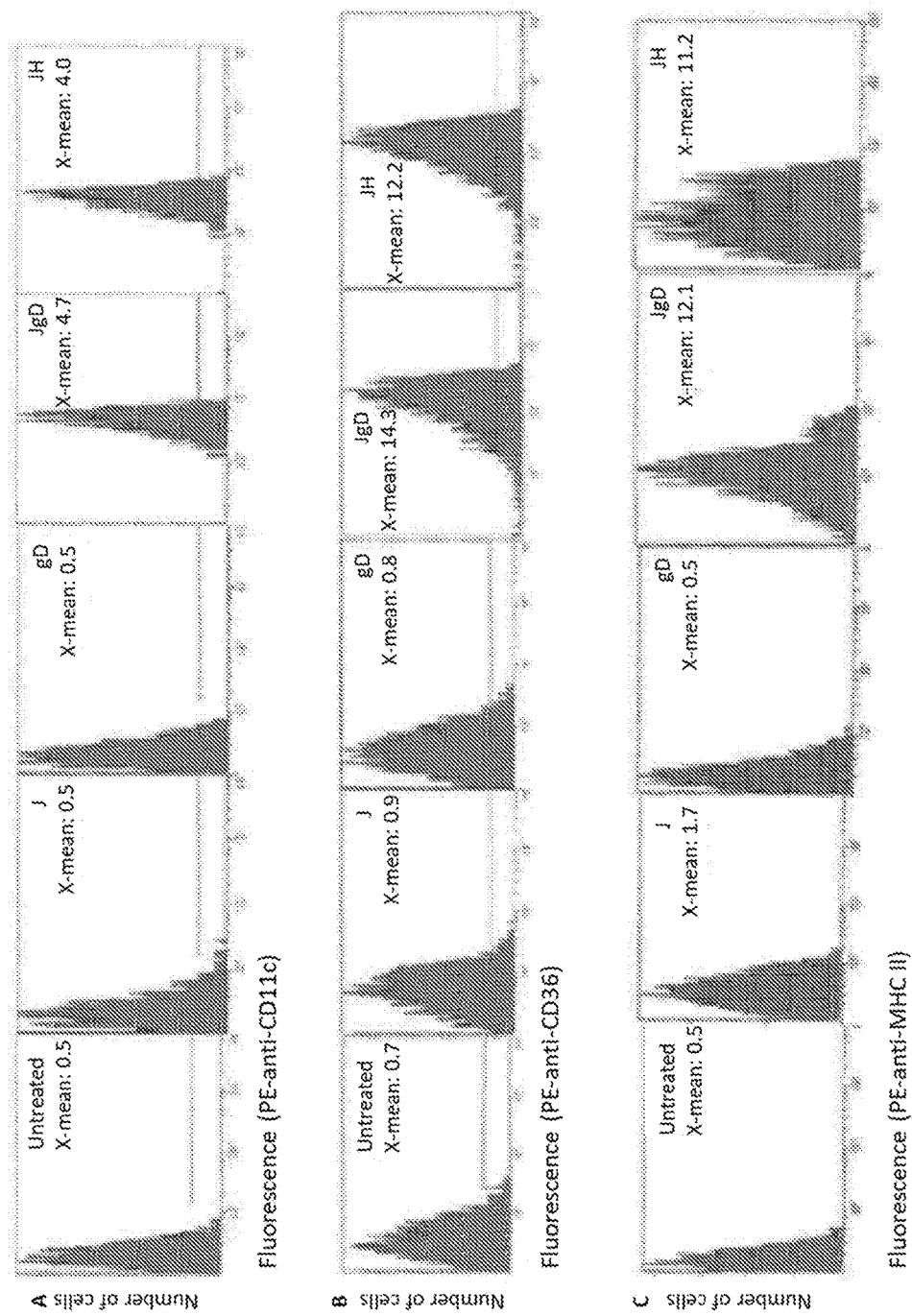
FIGS. 1A-1B show response of C57BL/6 bone marrow cells to JgD, J, gD, or JH immunogen treatments. JgD, J, gD, or JH were added to the BM cell suspensions and incubated for 48 hrs.

The present invention provides LEAPS™ peptide heteroconjugates useful as immunomodulators for modulated the immune response to an autoimmune condition. The present invention further provides LEAPS™ peptide heteroconjugates useful for treatment of cancers and localization of these LEAPS™ heteroconjugate-activated DCs at the site of cancer tumors and clusters of cancer cells. The DCs can be labeled to detect or visualize the site of the ongoing disease or cancer in the body of a subject. The novel heteroconjugates disclosed herein are based upon epitope or antigen sequences associated with a protein (or peptide) for specific forms of cancer.

The LEAPS™ peptide heteroconjugates disclosed herein have a protein sequence that binds to a specific class or subclass of immune cells and a protein sequence corresponding with an antigen. The LEAPS™ peptide heteroconjugates can be used to directly modulate the response of the immune system or specific immune cells to the antigen sequence. As such, the LEAPS™ peptide heteroconjugates disclosed herein can be used to direct an immune response against antigen sequences expressed by cancerous cells.

Various antigens associated with autoimmune conditions, often with defined epitopes recognized for some Human Leukocyte Antigens (HLA) genotypes, have been identified, including those associated with Insulin Dependent Diabetes Mellitus (IDDM), Rheumatoid Arthritis (RA) (e.g. collagen type II 390-402 IAGFKGEQGPKGE (SEQ ID No. 1), Systemic Lupus Erythematousis (SLE), Ankyosing Spondylitis (AS), Pemphius Vulgaris (PV) (epidermal cell adhesion molecule desmoglein 190-204). Multiple Sclerosis (MS), Myelinproteolipid (MPL) (peptide sequence KNIVTPRT (SEQ ID No. 2), certain types of psoriasis, and uveoretintis (Hammer et al., HLA class I peptide binding specificity and autoimmunity, 1997, Adv. Immunol, 66:67 Tisch et al., Induction of Glutamic Acid Decarboxylase 65-Specific Th2 Cells and Suppression of Autoimmune Diabetes at Late Stages of Disease Is Epitope Dependent 1999, J. Immunol. 163:1178; Yoon et al., Control of Autoimmune Diabetes in NOD Mice by GAD Expression or Suppression in .beta. Cells 1999, Science 284:1183; Ruiz et al., Suppressive Immunization with DNA Encoding a Self-Peptide Prevents Autoimmune Disease: Modulation of T Cell Costimulation 1999, J. Immunol., 162:3336; Kreo et al., Identification of T Cell Determinants on Human Type II Collagen Recognized by HLA-DQ8 and HLA-DQ6 Transgenic Mice 1999, J.

Immunol, 163:1661). In other cases, peptides are known that induce in animals, a condition similar to ones found in humans, such as GDKVSFFCKNKEKKC (SEQ ID No. 3) for antiphospholipid antibodies associated with thrombosis (Gharavi et al., GDKV-Induced Antiphospholipid Antibodies Enhance Thrombosis and Activate Endothelial Cells In Vivo and In Vitro 1999, J. Immunol., 163:2922) or myelin peptides for experimental autoimmune encephalitis (EAE) as a model for MS (Ruiz et al., supra. Araga et al., A Complementary Peptide Vaccine That Induces T Cell Anergy and Prevents Experimental Allergic Neuritis in Lewis Rats 1999, J. Immunol., 163:476-482; Karin et al., Short Peptide-Based Tolerogens Without Self-Antigenic or pathogenic Activity Reverse Autoimmune Disease 1999, J. Immunol, 160:5188; Howard et al., Mechanisms of immunotherapeutic intervention by anti-CD40L (CD154) antibody in an animal model of multiple sclerosis 1999, J. Clin Invest., 103:281).

Moreover, glutamic acid decarboxylase (GAD) and specific peptides have been identified associated with IDDM (Tisch et al., supra; Yoon et al., supra). Many of these conditions are also characterized by elevated levels of one or more different cytokines and other effectors such as Tumor Necrosis Factor (TNF) (Kleinau et al., Importance of CD23 for Collagen-Induced Arthritis: Delayed Onset and Reduced Severity in CD23-Deficient Mice 1999, J. Immunol. 162: 4266; Preckel et al., Partial agonism and independent modulation of T cell receptor and CD8 in hapten-specific cytotoxic T cells 1998. Eur. J. Immunol., 28:3706; Wooley et al., Influence of a recombinant human soluble tumor necrosis factor receptor FC fusion protein on type II collagen-induced arthritis in mice 1993, J. Immunol., 151:6602) as well as auto-antibodies, including in some cases, anti-costimulator molecules, in particular, those for Cytotoxic T-lymphocyte-Associated protein 4 ((CTLA-4) (CD152)) on CD4+ cells (Matsul et al., Autoantibodies to T Cell Costimulatory Molecules in Systemic Autoimmune Diseases 1999, J. Immunol., 162:4328).

Definitions

Unless defined otherwise, all technical and scientific terms used herein generally have the same meaning as commonly understood by one of ordinary skill in the relevant art.

The articles "a" and "an" are used herein to refer to one or to more than one (i.e., to at least one) of the grammatical object of the article. By way of example, "an element" means one element or more than one element.

The term "adjuvant" refers to substance that accelerates, prolongs or enhances antigen-specific immune responses when used in combination with vaccine antigens.

The terms "administering," "administer," "delivering," "deliver," "introducing," and "introduce" can be used interchangeably to indicate the introduction of a therapeutic or diagnostic agent into the body of a patient in need thereof to treat a disease or condition, and can further mean the introduction of any agent into the body for any purpose.

The term "antigen" refers to a substance or molecule that generates an immune response when introduced to the body or any molecule or fragment thereof now also refers to any molecule or molecular fragment that can be bound by a major histocompatibility complex (MHC).

The term "autoimmune disease" refers to a condition where a subject's own immune system directs an immune response against the subject's own cells and tissues. Autoimmune diseases include, but are not limited to, rheumatoid arthritis.

The term "blood tissue" refers to cells suspended in or in contact with plasma.

The term "bone marrow cell" refers to any cell originating from the interior of bones.

The terms "CD80," "CD86," "CD11c, "CD85" and similar terms refer to cell surface molecules present on leukocyte cells through a nomenclature protocol maintained by Human Cell Differentiation Molecules (www.hedm.org; Paris, France).

The terms "conjugate" "conjugation" and similar terms refer to two species being spatially associated with each other by covalent linkage, non-covalent binding or by a combination of covalent linkage and non-covalent binding. For example, an antibody can be conjugated to an epitope through non-covalent binding to the epitope as well as the antibody serving to conjugate the epitope (such as a cell surface marker) to a compound that is linked to the antibody.

The term "comprising" includes the recited steps, elements, structures or compositions of matter and does not exclude any un-recited elements, structures or compositions of matter.

The term "consisting of" includes and is limited to whatever follows the phrase the phrase "consisting of." Thus, the phrase indicates that the limited elements are required or mandatory and that no other elements may be present.

The phrase "consisting essentially of" includes any elements listed after the phrase and is limited to other elements that do not interfere with or contribute to the activity or action specified in the disclosure for the listed elements. Thus, the phrase indicates that the listed elements are required or mandatory but that other elements are optional and may or may not be present, depending upon whether or not they affect the activity or action of the listed elements.

A "dendritic cell" or "DC" refers to an antigen-presenting leukocyte that is found in the skin, mucosa, and lymphoid tissues, and having a capability under appropriate conditions to initiate a primary immune response by activating T cells, lymphocytes and/or secreting cytokines.

The term "diagnostic" refers to any technique for determining the presence of any particular autoimmune condition or antigen in a subject.

The term "divalent linker" refers to any moiety having a structure forming a peptide bond to a first peptide moiety and forming a second bond to a second peptide moiety.

The term "effect amount" is an amount of a therapeutic which produces a therapeutic response, including an immune response, in the subject to which the therapeutic is administered.

The term "autologous" refers to a situation where the donor and recipient of cells, fluids or other biological sample is the same person.

The term "homologous" refers to a situation where the donor are recipient of cells, fluids or other biological sample or material are not the same individual.

The term "infection" refers to the colonization in a host organism by a pathogenic agent that can include parasites, viruses, and bacteria.

An "immature dendritic cell" is a "dendritic cell" in a state characteristic of immune cells prior to contact with an antigen and having a limited present ability to active T cells, lymphocytes and/or to secrete cytokines; however, "immature dendritic cells" may acquire the ability to activate T cells, lymphocytes and secrete cytokines upon contact with an antigen.

The terms "immunomodulatory" and "immunoprotein" refer to a protein, peptide or cell having the ability to bind or interact with an immune cell to alter or to regulate one or more immune functions.

The term "Interleukin 12p70" refers to a cytokine produced by dendritic cells capable of directing the development of lymphocytes in a TH1 immune response, and possessing two peptides of approximately 40 kd and 35 kd in size.

The terms "isolated matured dendritic cells" or "isolated dendritic cells" refer to dendritic cells suspended in a liquid medium, a cell culture or a composition wherein at least 50% of the viable cells present in the liquid medium, the cell culture or the composition are dendritic cells or monocytes.

An "isotype control" is an antibody having the same serological structure and can have a fluorescent conjugate dye as an antibody conjugate having affinity for a cellular surface or cytokine marker, except the isotype control does not have affinity for the cellular surface or cytokine marker.

A "heteroconjugate" refers to a protein or peptide containing at least two amino acid sequences covalently linked to form a single molecular, wherein two sequences originate or are homologous to proteins expressed by different genes.

The term "maturation" refers to a process for generating a "matured dendritic cell."

The terms "matured dendritic cell," "maturated dendritic cell," "activated dendritic cell" or "effective dendritic cell" refer to a "dendritic cell" in a state characteristic of cells after contact with an antigen and having a present ability to initiate a primary immune response by activating T cells, lymphocytes and/or secreting cytokines.

The term "monocyte" refers to immune cells produced by bone marrow and haematopoietic stem cell having the ability to differentiate into macrophages or dendritic cells.

The term "magnetic resonance imaging" refers to any technique where information is collected from the exposure of a subject or sample to a magnetic field.

The terms "originating" and "derived" as related to peptide sequences refers to an organism or cell type that produces a protein containing The term "paramagnetic contrast agent" refers to any agent having paramagnetic behavior in an applied magnetic field indicated by a positive magnetic susceptibility.

The terms "peptide" and "peptide construct" refer to molecule including two or more amino acid residues linked by a peptide bond. The term "peptide" indicates molecular species where only part of the molecule has peptide character and/or where two parts or the molecular species formed of peptide bonds are covalently linked by a divalent linker.

The term "phenotype" as relating to the phenotype of immune cells refers to any observable characteristic or trait of a cell such as its morphology, development, biochemical or physiological properties including the expression or presence of specific cell surface proteins or markers.

The term "prophylactic" or "prophylactically" refers to a method or use of a peptide, cells or biological matter in a manner to prevent the onset or occurrence of a disease or infection including use as a vaccine.

The term "red blood cells" refers to erythrocytes having an intact phospholipid bilayer membrane.

The term "subject" or "patient" refers to an animal, including mice and humans, to which a therapeutic agent is administered.

The term "systemic immune response" refers to an immune response where antibodies, cytokines, or immune cells generated by the immune response are detectable throughout the circulatory and lymph systems of the body.

The term "T cell" refers to a lymphocytes having a T cell receptor protein on the surface of the cell.

The terms "treating" "treatment" as related to treating or treatment of immune cells refers to bringing an immune cell into contact with a substance or composition for a time period sufficient to cause a change in phenotype.

The term "vaccine" refers to compositions containing one or more antigens that stimulates an immune response when administered to an organism in vivo.

Structure of Immunomodulatory LEAPS™ Heteroconjugates

The peptide constructs disclosed herein are based on LEAPS™ technology and are heteroconjugates of two peptides which are linked together covalently. The peptide heteroconjugates or constructs can be synthesized artificially using solid-phase synthesis or other synthetic technique or expressed using recombinant DNA technology. The two peptides can be synthesized separately and joined covalently or can be synthesized or expressed as a single construct. A first peptide (hereinafter may be referred to as Peptide $P_1$) of the heteroconjugate is a portion of an immunoprotein capable of promoting binding to a class or subclass of dendritic cells (DCs) or T cells and is referred to as an immune cell binding ligand (ICBL). Without wishing to be bound by any particular theory, it is believed that Peptide $P_1$ has a structure for promoting interaction and/or binding with specific surface receptors present on DCs. Peptide $P_1$ can be a peptide sequence derived from Major Histocompatibility Complex (MHC) I or II. A more detailed discussion of the Peptide $P_1$ and peptide heteroconjugates involved with LEAPS™ technology can be found in U.S. Pat. No. 5,652,342, which is incorporated herein by reference.

A second peptide (hereinafter may be referred to as Peptide $P_2$) is a specific antigen peptide derived from and/or associated with an autoimmune condition or derived from a cancer cell. Without being wishing to be bound by any particular theory, it is believed that the antigen Peptide $P_2$ being covalently linked to the ICBL Peptide $P_1$ allows for a more effective recognition of the antigen Peptide $P_2$ by the immune system and specific immune cells thus allowing for antigen-specific immunomodulation. Peptide epitopes having a limited number of amino acid residues have sufficient structure to be bound by an antibody or an MHC molecule with a high degree of specificity. However, peptide epitopes of limited size are less competent to cross-link immunoglobulins to cause lymphocyte activation and/or capable of inducing an immune reaction or immunomodulations. As such, small peptide epitopes introduced into a subject may produce a poor immune response.

In the LEAPS™ heteroconjugates disclosed herein, the antigen Peptide $P_2$ is covalently bound to ICBL Peptide $P_1$ or other immunomodulatory peptide having the capability to bind to molecules present on the surface of dendritic cells or monocytes. Once bound to the surface of a dendritic cell, the antigen Peptide $P_2$ can then be recognized by local T cell receptor (TCR) or Major Histocompatibility Complex (MHC) molecules to trigger a corresponding immune response and/or immunomodulation through an immune recognition of the antigen Peptide $P_2$. In certain embodiments, DCs are treated or contracted with a LEAPS™ heteroconjugate ex vivo away from a subject's body and then administered to the subject. Through such a mechanism, the immune system of a subject to whom the LEAPS™ heteroconjugate-activated DCs are administered can be modulated to have a modulated response to a source of antigen with the body involved with the autoimmune condition. In certain other embodiments, the LEAPS™ heteroconjugate-activated DCs when administered to a subject locate to the site of a source of the antigen, whether such antigen source is a self-antigen involved in an autoimmune condition. The LEAPS™ heteroconjugate-activated DCs can be associated or conjugated with a radio label, dye, therapeutic compound or source of ionizing radiation to assist with the detection or imaging of the antigen source or to deliver the therapeutic compound or ionizing radiation to the site of the antigen source.

A further aspect of the LEAPS™ heteroconjugates disclosed herein is that the extent of pro-inflammatory or inflammatory cytokines produced during the immune response to the peptide constructs is reduced relative to levels typically associated with larger antigen proteins containing many different epitope sequences. Further, a Th1 type of immune response or a Th2 type of immune response may be promoted based upon the identity of the ICBL Peptide $P_1$ conjugated with the antigen Peptide $P_2$.

A further aspect of the LEAPS™ heteroconjugates disclosed herein is that the heteroconjugates can be treated or contacted with dendritic cells isolated from a subject or donor under conditions where the dendritic cells differentiate into more matured immune cells capable of directing immunity toward the antigen peptide sequence contained within the LEAPS™ heteroconjugates. The matured DCs can modulate immune response to sources of the antigen within the body of a subject to whom the matured DCs are administered.

The LEAPS™ heteroconjugates disclosed herein can assist in generating an active immune response to an antigen derived from a cancer cell. However, LEAPS™ heteroconjugates can also operate to downwards regulate the immune response to self antigens in individuals with an active autoimmune disease. As the Example below demonstrate, the LEAPS™ heteroconjugates disclosed herein have the capability to modulate an undesirable autoimmune response and cause a reduction in symptoms. The exact mechanism for immune modulation and/or a decrease in immune response in an antigen-specific matter is not fully known, and Applicants do not wish be bound by any particular theory regarding the mechanism of operation of the LEAPS™ heteroconjugates disclosed herein. In a study of the affect of LEAPS™ heteroconjugates in experimental autoimmune myocarditis (EAM), immunization of A/J mice with a LEAPS™ heteroconjugate having the pathogenic My-1 peptide from murine cardiac myosin linked to "J" peptide (described below) conferred both protection and treatment against EAM. These findings were for a L.E.A.P.S. vaccine protecting against EAM, a condition induced in A/J mice with the My-1 peptide from murine cardiac myosin. While the J-My-1 vaccine was not evaluated with other models, this condition can be induced by coxsackie virus B3 infection as well as immunization with murine cardiac myosin (MCM) 1. Therapies for EAM induced by My-1 such as monoclonal antibodies (for TNF-.alpha or IL-1, beta.), anti-complement receptor, cobra venom or recombinant proteins such as IFN-gamma are effective only if given in the first week, during the induction phase but are ineffective when given by day 10 or later. (Cihakova D. J G. Barin, M Kimura, G C Baldeviano, M V Talor, D H Zimmerman, E Taylor, N R Rose, 2008 Conjugated Peptide Ligand is Able to Prevent and Treat Experimental Autoimmune Myocarditis, is a Strong Stimulator of Cell and Humoral Immunity. *Int Immunopharmacol* 8:625-633 (which is incorporated herein by reference).

One possible conclusion is that the LEAPS™ heteroconjugate vaccine J-My1 was antigen specific (for My-1), did not induce a general anergy as no effect for the anti PPD response, had little effect on antibody to My-1, reduced proliferative responses to My-1 and did this without acting as a general mitogen or polyclonal activator. Expanded numbers of activated CD69+, CD44+, CD4+, and CD8+ cells, as well as increased CD11c+ DCs were observed in the spleens. No differences in CD4+, CD25+, and FoxP3+ Treg cell numbers were detected in the spleen or the target heart organ. Examination of the chemokine and cytokine response with the Quantikine ELISA kits for IFN-gamma, TGF-13, TNF-alpha, IL-1-alpha, IL4, IL10, IL2. Histamine, IP-10, MIP-1-alpha of sera and spleens were unremarkable, however cardiac tissue showed a significant decrease in MIP-1-alpha and IP10. This is in contrast to the elevated levels of these molecules in another EAM model and the ability of monoclonal antibody ablation to MIP-1-alpha or MCP-1 to reduce disease severity. Although IL-17 may be involved, it was not studied as reagents were not available.

Regardless of the theoretical mechanism for the action of LEAPS™ heteroconjugate vaccines in modulating immune response, the disclosure shows how to make and use effective LEAPS™ heteroconjugates.

LEAPS™ Heteroconjugates

Specifically, the novel peptide heteroconjugates of this invention include peptide constructs of the following Formulae (I) and (II):

$P_1$-x-$P_2$ (I)

$P_2$-x-$P_1$ (II)

where peptide $P_2$ is an antigen peptide associated with an autoimmune disease condition or associated with a cancer cell. It is believed that the antigen peptide $P_2$ binds to an antigen receptor on a set or subset of dendritic cells or T cell. $P_1$ is an immune response modifying peptide, which will cause a directed immune response by said set or subset of DCs or T cells to which the peptide $P_1$ is bound and modulates an immune response focused on IL-12 without or with low levels of pro-inflammatory or inflammatory cytokines (Patricia R Taylor; Christopher A Paustian, Gary K Koski, Daniel H Zimmerman, K S Rosenthal. Maturation of dendritic cell precursors into IL12 producing DCs by J-LEAPS. *Cellular Immunology,* 2010, 262:1-5; Taylor P R, G K Koski, C C Paustian, P A Cohen, F B-G Moore, D H Zimmerman, K S Rosenthal, J-L.E.A.P.S.™ Vaccines Initiate Murine TH1 Responses By Activating Dendritic Cells, *Vaccine* 2010: 28:5533-4, both of which are incorporated herein by reference). As shown in Formulae (I) and (II), the Peptide $P_1$ can be N-terminal or C-terminal to the Peptide $P_2$.

In certain embodiments, the Peptide $P_1$ contains an ICBL termed "J" or "Peptide J." Peptide J is derived from amino acids 38-50 from the β-2-microglobulin chain of the MHC 1 molecule (DLLKNGERIEKVE) (SEQ ID No. 49). ICBL Peptide J is believed, but is not limited to, promoting Th1-type immune responses to the coupled antigen $P_2$ peptide.

In certain embodiments, the Peptide $P_1$ of the peptide constructs contains an ICBL termed "CEL-1000" (DGQEEKAGVVSTGLI) (SEQ ID No. 48). The CEL-1000 peptide is derived from the β-chain of MHC II (MHC II β134-148) and binds to murine as well as human CD4+ cells. The chemical structure of conjugated peptides containing CEL-1000 can have an amidated carboxyl terminal, (amino)-DGQEEKAGVVSTGLI-(amide). CEL-1000 can be prepared by F-MOC chemistry and purified by Reverse Phase (RP)-HPLC, analyzed by another RP-PLC system, ion exchange chromatography (IEC)-HPLC as well as mass spectroscopy. Based on site directed mutagenesis studies of MHC II β-chain and/or peptide competition studies, peptides such as CEL-1000, were shown to bind to CD4, a T cell co-stimulator molecule (Cammarota et al., Identification of a CD4 binding site on the beta 2 domain of HLA-DR molecules. Nature, 1992: 356:799-801) and cell surface protein on some Dendritic Cell (DCs) (Konig, et. al., MHC class II interaction with CD4 medicated by a region analogous to the MHC class I binding site for CD8, Nature, 1992: 356:796-798; Shen X. and Konig R., "Regulation of T cell immunity and tolerance in vivo by CD4", Int. Immunol., 1998 10:247-57; Shen X. et al., Peptides corresponding to CD4-interacting regions of murine MHC class II molecules modulate immune responses of CD4+ T lymphocytes in vitro and in vivo, J. Immunol., 1996; 157:87-100, all of which are incorporated herein by reference).

In certain embodiments, the Peptide $P_1$ contains an ICBL termed "G" or "peptide G." Peptide G has the sequence NGQEEKAGVVSTGLI (SEQ ID No. 15) derived from the MHC-II beta 2 chain (Zimmerman et al., A new approach to T cell activation: natural and synthetic conjugates capable of activating T cells, 1996, Vacc. Res., 1996: 5:91, 5:102: Rosenthal et al., Immunization with a LEAPS™ heteroconjugate containing a CTL epitope and a peptide from beta-2-microglobulin elicits a protective and DTH response to herpes simplex virus type 1, 1999, Vaccine, 1999: 17(6): 535-542, both of which are incorporated herein by reference). In another embodiment, the Peptide $P_1$ contains Hu IL-10 and has the sequence DNQLLETCKQDRLRN-RRGNGSSTHFEGNLPC (SEQ ID No. 27) (Gesser et al., Identification of functional domains on human interleukin 10 1997, Proc. Nat. Acad. Sci. 94:14620).

In certain embodiments, the Peptide $P_1$ contains an ICBL termed "IL-1β" or "Peptide IL-1β." Peptide IL-1β has the sequence VQGEESNDK (SEQ ID No. 13) derived from the human interleukin-1β chain (e.g., Bajpai et al., Immunomodulating activity of analogs of noninflammatory fragment 163-171 of human interleukin-1beta 1998 Immunopharmacology, 38:237, incorporated herein by reference).

In certain addition embodiments, the Peptide $P_1$ contains ICAM-1 LFA-3 (aa26-42). VLWKKQKDKVAELENSE (SEQ ID No. 4); a TNF-α ligand portion such as amino acids 70-80 PSTHVLITHTI (SEQ ID No. 5); or the peptide represented by peptide represented by DFLPHYKNT-SLGHRP (SEQ ID No. 6).

Epitope sequences that can serve as the antigen Peptide $P_2$ and conjugated with the ICBL Peptide $P_1$ to form a LEAPS™ heteroconjugate will now be described. The antigen Peptide $P_2$ can be selected from protein sequences associated with different types of autoimmune conditions, including Alzheimer's dementia (immune response to ameloid β protein implicated), myocarditis, diabetes mellitus, rheumatoid arthritis, pemphigus vulgaris, multiple sclerosis, uveoretinitis, thrombosis, myastmenia gravis, psoriasis, pernicious anemia, autoimmune hepatitis, systemic lupus erythematosus, rheumatic fever, Graves disease, systemic sclerosis, and Goodpature's syndrome. While Alzheimer's dementia may not generally be considered to be a disorder of the immune system, plaques formed by Alzheimer's can be treated in a similar manner as autoimmune diseases. As such, Alzheimer's disease is considered to be within the scope of autoimmune diseases treatable through the use of LEAPS™ heteroconjugates as disclosed herein.

In other embodiments, epitope sequences that can serve as the antigen $P_2$ peptide and conjugated with the ICBL Peptide $P_1$ to form a LEAPS™ heteroconjugate can be selected from protein sequences associated with different types of cancer including liver, colon, breast, cervical, melanoma, prostate, ovarian, colorectal, gastric, lung and cervical cancers. Protein sequences and antigens associated with cancer ultimately derive from the host's own genome. As such, antigens associated with cancer can have a weak immune response due to suppression of the recognition of self-antigens by a host. However, some cancer cells express proteins, some of which are present on the surface of cancer cells that contain mutations compared to surrounding non-cancerous cells. However, even the presence of mutated proteins in cancers often does not engender a strong host immune response since such mutated protein sequences are often not processed by antigen presenting cells (APCs), which is a typical first step in directing an immune response against a specific antigenic peptide sequence.

LEAPS™ heteroconjugates having immunomodulatory effects on specific autoimmune conditions or having immunomodulatory effects toward cancer are contemplated containing any combination of sequences selected from embodiments of Peptide $P_1$ ICBLs, described above, and Peptide $P_2$ presented on Table 1 for autoimmune diseases or Table 2 for cancer having the structure of one of Formulae (I) and (II), as described above. In Formulae (I) and (II), -x- represents a covalent bond or a divalent peptide linking group providing a covalent linkage between Peptide $P_1$ and Peptide $P_2$. In certain embodiments, -x- is a divalent peptide linking group having one or more glycine residues, such as the divalent linking group -GGG- or -GG-. In order to avoid synthesis of peptides having four glycine residues in a row, which may be hard to synthesize, a linking group of -GG- can be used. Divalent linkers containing the residue serine can also be present in the divalent linking group, -x-. For example, divalent linking group can be -GGSG- (SEQ ID No. 1092), -GGGS- (SEQ ID No. 7) or -GGGGS- (SEQ ID No. 1093).

In certain embodiments, the divalent linking group is not limited to any particular identity so long as the linking group -x- serves to covalently attach the Peptide $P_1$ and Peptide $P_2$ as shown in Formulae (I) and (II). The linking group -x- can contain one or more amino acid residues or a bifunctional chemical linking group, such as, for example, N-succinimidyl-3-(2-pyridyldithio)propionate (SPDP), m-maleimidobenzoyl-N-hydroxy-succimide ester (MBS), or 1-ethyl-3-(3-dimethylaminopropyl)carbodiimide (EDC). In certain embodiments, the linking group -x- can be a direct peptide or other covalent bond directly coupling Peptide $P_1$ and Peptide $P_2$. In certain embodiments where the linking group -x- contains amino acid residue, the linking group -x- can contain from 1 to about 5 amino acid residues or from 1 to about 3 amino residues. In certain embodiments, the linking group -x- can be cleavable or non-cleavable under physiological conditions.

The LEAPS™ heteroconjugates of Formulae (I) and (II) can be modified including modifications to the N- or C-terminal or the heteroconjugates. The LEAPS™ heteroconjugates described by Formulae (I) and (II) contain a sequence of amino acid residues consistent with the described Peptide $P_1$ and Peptide $P_2$. However, the N- or C-terminal of the described LEAPS™ heteroconjugates can be modified by any one or more of amidation or acylation, including myristoylation.

In certain embodiments, Peptides $P_1$ and $P_2$ and peptide heteroconjugates including peptides $P_1$ and $P_2$ include variants of any sequence presented herein in SEQ ID No.'s 1-1090. A variant is herein defined as a sequence wherein 1, 2, 3, 4 or 5 amino acid residues of any sequence disclosed herein are replaced with a different amino acid residue without affecting the ability of the LEAPS™ heteroconjugates to stimulate an immune response. In certain embodiment, variants have amino acid residues substituted in a conserved manner. In certain other embodiments, variants to SEQ ID No.'s 1-1090 have amino acid residues substituted in a non-conserved manner. Variants to SEQ ID No.'s 1-1090 include amino acid sequences where 1, 2, 3, 4 or 5 amino acid residues are deleted from the sequences and/or 1, 2, 3, 4 or 5 amino acid residues are added to the sequences. Variants include embodiments where combinations of conserved or non-conserved substitutions, additions and/or deletions are made to a sequence.

A conserved substitution is a substitution where an amino acid residue is replaced with another amino acid residue having similar charge, polarity, hydrophobicity, chemical functionality, size and/or shape. Substitution of an amino acid residue in any of the following groups with an amino acid residue from the same group is considered to be a conserved substitution: 1) Ala and Gly; 2) Asp and Glu; 3) Ile, Leu, Val and Ala; 4) Lys, Arg and His; 5) Cys and Ser; 6) Phe, Trp and Tyr; 7) Phe and Pro; 8) Met and Nle (norleucine); 9) Asn and Gln; and 10) Thr and Ser.

Table 1 shows exemplary antigens that can be employed as Peptide $P_2$ in certain embodiments. LEAPS™ heteroconjugates consistent with Formulae (I) and (II) can be formed by combining any permutation of ICBL peptide $P_1$ (e.g., CEL-1000, Peptide J and/or Peptide G, etc.) with an antigen (Peptides $P_2$) as presented in Table 1. Table 1 lists antigen sequences grouped by the condition or disease that such sequences are associated with. Specifically, the first column of Table 1 list the SEQ ID No. for the sequence presented in each row. The second column lists the disease, such as an autoimmune condition, for which the sequences presented in each row relate. The third column specifies the protein from which individual amino acid sequences are derived. The fourth column gives the abbreviation for which the sequence presented in each row can be referred to. For example, AB1-42 stands for ameloid β protein, residues 1-42, whereas J-AB1-42 indicates a LEAPS™ heteroconjugate having the ICBL Peptide J linked to ameloid β protein, residues 1-42. Also provided on Table 1 are example LEAPS™ heteroconjugates, where Peptide $P_1$ is Peptide J (SEQ ID No. 49) combined with an antigen Peptide $P_2$. The fifth Column specifies the core epitope sequence, if any, for the protein described in each row, and the sixth column specifies an extended epitope sequence associated with the protein described in each row. The seventh column indicates the range of amino acids from the described protein corresponding to the epitope sequence. The eighth column specifies an exemplary LEAPS™ heteroconjugate where the ICBL Peptide J (SEQ ID No. 49) is linked to one of the described antigens through a triglycine linker. Those skilled in the art will recognize that other LEAPS™ heteroconjugate constructs can be formed substituting for Peptide $P_1$ and Peptide $P_2$, where the examples on Table 1 are merely illustrative and are not limiting. The ninth column lists any know references describing the extended or core epitope sequences, if known. References are specified by a number corresponding to the list of references found at the end of this disclosure.

In addition to the antigen sequences disclosed in Table 1, U.S. Paten Publication 2006/0257420 A1 and U.S. Patent Publication U.S. Patent Publication 2011/0098444 A1 are expressly incorporated herein by reference.

TABLE 1

Autoimmune related antigens and example LEAPS™ heteroconjugates

| Seq ID No. | Disease | Protein Candidates | Abbreviation | Core epitope | Extended region | Amino acid position | J LEAPS conjugate | Ref. |
|---|---|---|---|---|---|---|---|---|
| 51 | Alzheimers dementia | ameloid b protein | Ab1-42 | NA | DAEFRHDSGYEVHHQKLVFFAED VGSNKGAIIGLMVGGVV | 1-42 | NA | 3 |
| 291 | | | J-Ab1-42 | NA | NA | NA | DLLKNGERIEKVEGGGDAEFRHDSGYEV HHQKLVFFAEDVGSNKGAIIGLMVGGVV | 66 |
| 53 | Alzheimers dementia | ameloid b protein | Ab1-28 | NA | DAEFRHDSGYEVHHQKLVFFAEN VGSNK | 1-28 | NA | 3, 4 |
| 293 | | | J-Ab1-28 | NA | NA | NA | DLLKNGERIEKVEGGGDAEFRHDSGYEV HHQKLVFFAENVGSNK | |
| 55 | Alzheimers dementia | ameloid b protein | Ab1-30 | NA | DAEFRHDSGYEVHHQKLVFFAEN VGSKAI | 1-30 | NA | 3, 4 |
| 856 | | | J-Ab1-30 | NA | NA | NA | DLLKNGERIEKVEGGGDAEFRHDSGYEV HHQKLVFFAENVGSKAI | |
| 960 | Alzheimers dementia | ameloid b protein | Ab1-15 | | DAEFRHDSGYEVHHQ | 1-15 | NA | 75, 76, 77 |
| 964 | | | J-Ab1-15 | | | | DLLKNGERIEKVEGGGDAEFRHDSGYEV HHQ | |
| 961 | Alzheimers dementia | ameloid b protein | Ab12-33 | | KLVFFAEDVGSNKGAIIG | 16-33 | NA | 77, 78, 79 |
| 965 | | | J-Ab33 | | | | DLLKNGERIEKVEGGGKLVFFAEDVGSN KGAIIG | |
| 962 | Rheumatoid Arthritis | Type II Cplagen | CII-354 CII-350 | GARGLTGRPGDA | PGLPCARGLTGRPGDAGPQG | 354-365 350-369 | NA | 80 81 |
| 963 966 | | | J-CII-350 | | | | DLLKNGERIEKVEGGGPGLPGARGLTGR PGDAGPQG | |
| 749 | Myocarditis | Myosin | My4 | NA | KRKLEGDLKLTQESIMDLENDKQQL | 800-824 | NA | 5 |
| 857 | | | J-My4 | NA | NA | NA | DLLKNGERIEKVEGGGKRKLEGDLKLTQ ESIMDLENDKQQL | 40 |
| 72 | Myocarditis | cardiac antigen trponin I | CATI | NITEIADLTQK | NA | 121-131 | NA | 6 |
| 917 | | | CATIext | NA | AKVTKNITEIEADLTQKIFDLR | 116-136 | NA | 41 |
| 858 | | | J-CATIext | NA | NA | NA | DLLKNGERIEKVEGGGAKVTKNITEIEA DLTQKIFDLR | |

TABLE 1 -continued

Autoimmune related antigens and example LEAPS™ heteroconjugates

| Seq ID No. | Disease | Protein Candidates | Abbreviation | Core epitope | Extended region | Amino acid position | J LEAPS conjugate | Ref. |
|---|---|---|---|---|---|---|---|---|
| 751 | Myocarditis | | BCKD-E2 116-134 | NA | VRRALMENNIKLSEVVGSG | 116-134 | NA | 7, 67 |
| 859 | | | J-BKD116 | NA | NA | NA | DLLKNGERIEKVEGGGVRRALMENNIKL SEVVGSG | |
| 753 | Myocarditis | | LMM1.1 | NA | KEALISSLTRGKLTYTQQ | NA | NA | 8, 40 |
| 860 | | | J-LMM1 | NA | NA | NA | DLLKNGERIEKVEGGGKEALISSLTRGK LTYTQQ | |
| 755 | Myocarditis | | LMM33 | NA | SERVQLLHSQNTSLINQK | NA | NA | 8, 40 |
| 861 | | | J-LMM33 | NA | NA | NA | DLLKNGERIEKVEGGGSERVQLLHSQNT SLINQK | |
| 957 | Diabetes mellitus | Insulin Growth Factor Receptor I | IGF1R | SFGVVLWEI | NA | 1196-1204 | NA | 37, 29 |
| 958 | | | IGF1Rext | NA | YSDVWSFGVVLWEIATLAE | 1191- | NA | 42 |
| 862 | | | J-IGF1Rext | NA | NA | NA | DLLKNGERIEKVEGGGYSDVWSFGVVLW EIATLAE | |
| 84 | Diabetes | Bovine serum albumin | ABBOS 152 | NA | FKADEKKFWGKYLYE | 152 | NA | 13, 68 |
| 325 | | | J-ABBOS152 | NA | NA | NA | DLLKNGERIEKVEGGGFKADEKKFWGKY LYE | |
| 86 | Diabetes | Insulin beta chain | Insβ 9 | NA | SHLVEALYLVCGERG | 9 | NA | 14, 69 |
| 863 | | | J-Insβ9 | NA | NA | NA | DLLKNGERIEKVEGGGSHLVEALYLVCG ERG | |
| 88 | Diabetes | Heat shock protein | HSP277 | NA | VLGGGCALLRCIPALDSLTPANED | 277 | NA | 15, 70 |
| 864 | | | J-HSP277 | NA | NA | NA | DLLKNGERIEKVEGGGVLGGGCALLRCI PALDSLTPANED | |
| 90 | Diabetes | | RVEp151 | NA | EACVTSWLWSGEGAVFYRVDLH FINLGT | 151 | NA | 16, 71 |
| 331 | | | J-RVEp151 | NA | NA | NA | DLLKNGERIEKVEGGGEACVTSWLWSGE GAVFYRVDLHFINLGT | |
| 92 | Diabetes | | RVEp87 | NA | MDFWCVEHDRPPATPTSLTT | 87 | NA | 16, 71 |
| 341 | | | J-RVEp87 | NA | NA | NA | DLLKNGERIEKVEGGGMDFWCVEHDRPP PATPTSLTT | |

TABLE 1-continued

Autoimmune related antigens and example LEAPS™ heteroconjugates

| Seq ID No. | Disease | Protein Candidates | Abbreviation | Core epitope | Extended region | Amino acid position | example LEAPS conjugate | Ref. |
|---|---|---|---|---|---|---|---|---|
| 74 | Diabetes | Glutamic acid decarboxylase p65 | GAD65-247 | NA | NA | 247-265 | NA | 9, 43 |
| 317 |  |  | J-GAD65-247 | NA | NMYAMMIARFKMPPEVKEKGMA ALPRLIAFTSEHSHFSLK | NA | DLLKNGERIEKVEGGGNMYAMMIARFKM FPEVKEKGMAALPRLIAFTSEHSHFSLK |  |
| 76 | Diabetes | Glutamic acid decarboxylase p65 | GAD65-253 | NA | LARFKMFPEVKEKGMAALPRIAF TSEHSHFSLK | 253 | NA | 43 |
| 317 |  |  | J-GAD65-253 | NA | NA | NA | DLLKNGERIEKVEGGGLARFKMFPEVKE KGMAALPRIAFTSEHSHFSLK |  |
| 78 | Diabetes | Glutamic acid decarboxylase p65 | GAD65-524 | NA | SRLSKVAPVIKARMMEYGTT | 524 | NA | 10, 43 |
| 319 |  |  | J-GAD65-524 | NA | NA | NA | DLLKNGERIEKVEGGGSRLSKVAPVIKA RMMEYG |  |
| 80 | Diabetes | Glutamic acid decarboxylase p65 | GAD65-506 | NA | IPPSLRYLEDEERMSRLSK | 506 | NA | 11, 43 |
| 865 |  |  | J-GAD65-506 | NA | NA | NA | DLLKNGERIEKVEGGGIPPSLRYLEDEE RMSRLSK |  |
| 82 | Diabetes | Glutamic acid decarboxylase p65 | GAD65-201 | NA | NTNMFTYEIAPVFVLLEYVT | 201 | NA | 12, 43 |
| 866 |  |  | J-GAD65-201 | NA | NA | NA | DLLKNGERIEKVEGGGNTNMFTYEIAPV FVLLEYVT |  |
| 98 | Diabetes | Glutamic acid decarboxylase p65 | GAD274 | NA | IAFTSEHSHFSLK | 274 | NA | 17, 43 |
| 339 |  |  | J-GAD274 | NA | NA | NA | DLLKNGERIEKVEGGGIAFTSEHSHFSLK |  |
| 103 | Diabetes | Glutamic acid decarboxylase p65 | GAD122 | DRSTKVIDFH | VVKSFDRSTKVIDHYPNEL | 127-136 122-141 | NA | 17 43 |
| 918 |  |  | J-GAD122 | NA | NA | NA | DLLKNGERIEKVEGGGVVKSFDRSTKVID FHYPNEL |  |
| 867 |  |  |  | NA | NA | NA |  |  |
| 449 | Diabetes | Glutamic acid decarboxylase p65 | GAD654 | NA | VSSVSSQFSDAAQASPSSHSS | 654-674 | NA | 17, 43 |
| 868 |  |  | J-GAD654 | NA | NA | NA | DLLKNGERIEKVEGGGVSSVSSQFSDAAQ ASPSSHSS |  |
| 452 | Diabetes | Glutamic acid decarboxylase p65 | GAD797 | NA | MVWESGCTVIVMLTPLVEDGV | 797-717 | NA | 17, 43 |
| 869 |  |  | J-GAD797 | NA | NA | NA | DLLKNGERIEKVEGGGMWESGCTVIVML TPLVEDGV |  |

TABLE 1 -continued

Autoimmune related antigens and example LEAPS™ heteroconjugates

| Seq ID No. | Disease | Protein Candidates | Abbreviation | Core epitope | Extended region | Amino acid position | J LEAPS conjugate | Ref. |
|---|---|---|---|---|---|---|---|---|
| 469 | Diabetes | Glutamic acid decarboxylase p65 | GAD854 | NA | FYLKNVQTQETRTLTQFHF | 854-872 | NA | 17, 43 |
| 870 | | | J-GAD854 | NA | NA | NA | DLLKNGERIEKVEGGGFYLKNVQTQETRT LTQFHF | |
| 812 | Rheumatoid arthritis | Human collagen Type II | CEL-2000 | NA | TGGKPGIAGFKGEQGPKGEP | 254-273 | NA | 72 |
| 828 | | | | NA | NA | NA | DLLKNGERIEKVEGGGTGGKPGIAGFKGE QGPKGEP | |
| 1 | Rheumatoid Arthritis | collagen Type II | C-IIx | IAGFKGEQGPKGE | NA | 399-402 | NA | 1 |
| 347 | | | J-CIIx | NA | NA | NA | DLLKNGERIEKVEGGGIAGFKGEQGPKGE | 72 |
| 474 | Rheumatoid arthritis | Human collagen Type II | G54 | NA | DGEAGKPGKAGERGPPGPQG | 54-73 | NA | 18, 72 |
| 871 | | | J-G54 | NA | NA | NA | DLLKNGERIEKVEGGGDGEAGKPGKAGER GPPGPQG | |
| 477 | Rheumatoid arthritis | Human collagen Type II | K94 | NA | GLDGAKGEAGAPGVKGESGS | 94-113 | NA | 18, 72 |
| 872 | | | J-K94 | NA | NA | NA | DLLKNGERIEKVEGGGLDGAKGEAGAPG VKGESGS | |
| 482 | Rheumatoid arthritis | Human collagen Type II | P544 | NA | ERGAAGIAGDKGDRGDVGEK | 544-573 | NA | 18, 72 |
| 873 | | | J-P544 | NA | NA | NA | DLLKNGERIEKVEGGGERGAAGIAGDKGD RGDVGEK | |
| 487 | Rheumatoid arthritis | Osteopontin | OPN OPN143 | SLAYGLR NA | NA DGRGDSLAYGLRSKSKK | 148-154 143-159 | NA NA | 19 44 |
| 874 | | | J-OPN143 | NA | NA | NA | DLLKNGERIEKVEGGGDRGDSLAYGLR SKSKK | |
| 490 | Rheumatoid arthritis | dnaJP1 | DNAJ1 | NA | QKRAAYKQYGHAAFE | NA | NA | 20 45 |
| 875 | | | J-DNAJ1 | NA | NA | NA | DLLKNGERIEKVEGGGQKRAAYKQYGHA AFE | |
| 493 | Rheumatoid arthritis | dnaJPV | DNAJV | NA | ERAAYDQYGHAAFE | 461 | NA | 20 73 |
| 876 | | | J-DNAJV | NA | NA | NA | DLLKNGERIEKVEGGGERAAYDQYGHAA FE | |

TABLE 1-continued

Autoimmune related antigens and example LEAPS™ heteroconjugates

| Seq ID No. | Disease | Protein Candidates | Abbreviation | Core epitope | Extended region | Amino acid position | J LEAPS conjugate | Ref. |
|---|---|---|---|---|---|---|---|---|
| 919 | Pemphigus vulgaris | Cadherin | Cad1 | GGGTGGGGG | NA | 394-403 | NA | 37.12 |
| 920 | | | Cad1ext | NA | CRVLGGGTGGGGGLGGPG | 389-408 | NA | 46 |
| 877 | | | J-Cad1ext | NA | NA | NA | DLLKNGERIEKVEGGCRVLGGGTGGGGGLGGPG | |
| 921 | Pemphigus vulgaris | Cadherin | Cad2 | AVAAVAAAG | NA | 19-27 | NA | 37.12 |
| 922 | | | Cad2ext | NA | CLGLLAVAVAAGANPAQ | 14-31 | NA | 47 |
| 878 | | | J-Cad2ext | NA | NA | NA | DLLKNGERIEKVEGGCLGLLAVAVAAGANPAQ | |
| 496 | Pemphigus vulgaris | epidermal cell adhesion molecule desmoglein | DG342-358 | NA | SVKLSIAVNKAEFHQS | 342-358 | NA | 21 |
| 782 | | | | NA | NA | NA | DLLKNGERIEKVEGGGSVKLSIAVNKAEFHQS | 48 |
| 499 | Pemphigus vulgaris | epidermal cell adhesion molecule desmoglein | DG376-392 | NA | NVREGIAFRPASKFTV | 376-392 | NA | 21 |
| 879 | | | J-DG376 | NA | NA | NA | DLLKNGERIEKVEGGGNVREGIAFRPASKFTV | 48 |
| 2 | Multiple Sclerosis | Myelin basis protein | MBP | KNIVTPRT | NA | 118-125 | NA | |
| 959 | | | MBPext | NA | VVHFFKNIVTPRTPPPSQ | 113-130 | NA | |
| 881 | | | J-MBPext | NA | NA | NA | DLLKNGERIEKVEGGGVVHFFKNIVTPRTPPPSQ | 49 |
| 524 | Multiple Sclerosis | Proteolipoprotein | PLP | HSLGKWLGHPDKF | NA | 139-151 | NA | 24 |
| 924 | | | PLPext | NA | LERVCHSLGKWLGHPDKFVGITY | 134-156 | NA | 50 |
| 883 | | | J-PLPext | NA | NA | NA | DLLKNGERIEKVEGGGLERVCHSLGKWLGHPDKFVGITY | |
| 527 | Multiple Sclerosis | Peripheral Nerve protein P2 | P2 | TEISFKLGQEF | NA | 61-71 | NA | 25 |
| 925 | | | P256 | NA | STFKNTEISFKLGQEFEETTA | 56-76 | NA | 51 |
| 884 | | | J-P256 | NA | NA | NA | DLLKNGERIEKVEGGGSTFKNTEISFKLGQEFEETTA | |
| 549 | Multiple Sclerosis | Proteolipoprotein | PLP | NA | NA | 175-192 | NA | 23, 50 |
| 925 | | | PLP175 | NA | IYFNTWTTCQSIAFPSKT | | NA | |
| 886 | | | J-PLP175 | NA | NA | NA | DLLKNGERIEKVEGGGIYFNTWTTCQSIAFPSKT | |
| 552 | Multiple Sclerosis | myelin-associated oligodendrocytic | MOGP15 | NA | QKFSEHFSIHCCPPFTFLNSSKR | 15-36 | NA | 26, 52 |
| 887 | | | J-MOGP15 | NA | NA | NA | DLLKNGERIEKVEGGGQKFSEHFSIHCCPPFTFLNSSKR | |

TABLE 1-continued

Autoimmune related antigens and example LEAPS™ heteroconjugates

| Seq ID No. | Disease | Protein Candidates | Abbreviation | Core epitope | Extended region | Amino acid position | J LEAPS conjugate | Ref. |
|---|---|---|---|---|---|---|---|---|
| 555 | Multiple Sclerosis | myelin-associated oligodendrocytic | MOGP1-20 | NA | NA | 1-20 | NA | 26, 52 |
| 888 | | | J-MOGP1-20 | NA | GQPRVIGPRHPIRALVGDEV | NA | DLLKNGERIEKVEGGGGQPRVIGPRHP IRALVGDEV | |
| 572 | Multiple Sclerosis | myelin-associated oligodendrocytic | MOGP31 | NA | NA | 31-50 | NA | 26 |
| 889 | | | J-MOGP31 | NA | NATGMEVGWYRPPFSRVVHL | NA | DLLKNGERIEKVEGGGNATGMEVGWYR PPFSRVVHL | 52 |
| 588 | Multiple Sclerosis | myelin-associated oligodendrocytic | MOGP91 | NA | NA | 91-110 | NA | 26 |
| 890 | | | J-MOGP91 | NA | SDEGGFTCFFRDHSYQEEAA | NA | DLLKNGERIEKVEGGGSDEGGFTCFFR DHSYQEEAA | 52 |
| 581 | Multiple Sclerosis | Proteolipoprotein | MOGP61 | NA | NA | 61-80 | NA | 26, 52 |
| 891 | | | J-MOGP61 | NA | QAPETRGRTELLKDAIGEGK | NA | DLLKNGERIEKVEGGGQAPETRGRTEL LKDAIGEGK | |
| 597 | Multiple Sclerosis | Mylein basis protein | MBP85 | NA | NA | 85-99 | NA | 27, 49 |
| 892 | | | J-MBP85 | NA | ENPVVHFFKNIVTPR | NA | DLLKNGERIEKVEGGGENPVVHFFKNI VTPR | |
| 606 | Multiple Sclerosis | Proteolipoprotein | PLP184 | NA | NA | 184-199 | NA | 28, 50 |
| 893 | | | J-PLP184 | NA | QSLAPPSKTSASIGSL | NA | DLLKNGERIEKVEGGGQSLAPPSKTSA SIGSL | |
| 609 | Multiple Sclerosis | Proteolipoprotein | PLP190 | NA | NA | 190-209 | NA | 28, 50 |
| 894 | | | J-PLP190 | NA | SKTSASIGSKCADARMYGVL | NA | DLLKNGERIEKVEGGGSKTSASIGSKC ADARMYGVL | |
| 612 | Multiple Sclerosis | myelin-associated oligodendrocytic | MOG97 | FFRDHSYQE | NA | 97-108 | NA | 29 |
| 950 | | | | NA | GGFTCFFRDHSYQEEAAME | 92-113 | | 52 |
| 895 | | | J-MOG97 | NA | NA | NA | DLLKNGERIEKVEGGGGFTCFFRDHS YQEEAAME | |
| 623 | Multiple Sclerosis | Proteolipoprotein | PLP40 | NA | NA | 40-60 | NA | 50 |
| 897 | | | J-PLP40 | NA | TGTEKLIETYFSKNYQDYEYL | NA | DLLKNGERIEKVEGGGTGTEKLIETYF SKNYQDYEYL | |

TABLE 1 -continued

Autoimmune related antigens and example LEAPS™ heteroconjugates

| Seq ID No. | Disease | Protein Candidates | Abbreviation | Core epitope | Extended region | Amino acid position | J LEAPS conjugate | Ref. |
|---|---|---|---|---|---|---|---|---|
| 636 | Multiple Sclerosis | myelin-associated oligodendrocytic | MOG37 | NA | VGWYRPPFSRVVHLYR | 37-52 | NA | 31, 52 |
| 899 | | | J-MOG37 | NA | NA | NA | DLLKNGERIEKVEGGGVGWYRPPFSRV VHLYR | 31 52 |
| 641 | Multiple Sclerosis | myelin-associated oligodendrocytic | MOG145 | NA | VFLCLQYRLRGKLRAE | 145-160 | NA | 32, 53 |
| 900 | | | J-MOG145 | NA | NA | NA | DLLKNGERIEKVEGGGVFLCLQYRLRG KLRAE | 31 52 |
| 653 | Uveoretinitis | interphotoreceptor retinoid binding protein | IRBP | NA | DGSSWEGVGVPDV | 1202-1215 | NA | 32 53 |
| 901 | | | J-IRBP | NA | NA | NA | DLLKNGERIEKVEGGGDGSSWEGVGVV PDV | |
| 664 | Uveoretinitis | interphotoreceptor retinoid binding protein | IRBP1 | NA | GPTHLFQPSLVLDMAKVLLD | 1-20 | NA | 33, 53 |
| 786 | | | J-IRBP1 | NA | NA | NA | DLLKNGERIEKVEGGGGPTHLFQPSLV LDMAKVLLD | |
| 3 | Thrombosis | Beta-2- Glycoprotein 1 | GP1 | GDKVSFFCKNKEKKCNA | NGMLHGDKVSFFCKNKEKKCSYTED | 274-288 269-293 | NA | 2 54 |
| 927 902 | | | GPIext J-GPIext | NA NA | NA | NA | DLLKNGERIEKVEGGGNGMLHGDKVSF FCKNKEKKCSYTED | |
| 19 | Myastmenia Gravis | acetyl cholinereceptor Receptor | AchR 129 | NA | EIIVTHPFDEQNCSMK | 129-145 254-276 | NA | 34, 55 |
| 355 903 | | | J-ArchR129 | NA | NA | NA | DLLKNGERIEKVEGGGEIIVTHPFPDE QNCSMK | 55 |
| 737 | Myastmenia Gravis | acetyl cholinereceptor Receptor | AchR 259 | VIVELIPSTSSAV | TVFLLVIVELIPSTSSSAVPLIGK | 259-271 254-276 | NA | 34, 35 55 |
| 951 903 | | | J-ArchR259 | NA | NA | NA | DLLKNGERIEKVEGGGTVFLLIVIVELI PSTSSAVPLIGK | |
| 738 | Myastmenia Gravis | acetyl cholinereceptor Receptor | AchR 195 | NA | DTPYLDITYHFVMQRLPL | 195-212 | NA | 35, 55 |
| 904 | | | J-ArchR195 | NA | NA | NA | DLLKNGERIEKVEGGGDTPYLDITYHF VMQRLPL | 55 |
| 774 | Psorasis | | Pso P27 | NA | SVDRSGNVHHQFQKLTLE | 18 Jan. | NA | 36 |
| 804 | | | | NA | NA | NA | DLLKNGERIEKVEGGGSVDRSGNVHHQ FQKLTLE | 74 |

TABLE 1 -continued

Autoimmune related antigens and example LEAPS™ heteroconjugates

| Seq ID No. | Disease | Protein Candidates | Abbreviation | Core epitope | Extended region | Amino acid position | J LEAPS conjugate | Ref. |
|---|---|---|---|---|---|---|---|---|
| 947 928 906 | Prenicious Anemia | H⁺K⁺ATPase | H/KATPase H/KATPase J-ATPase | EEEAEEEA NA NA | NA NYLADEEEAEEEARVTVV NA | 35-43 30-48 NA | NA NA DLLKNGERIEKVEGGGNYLADEEEAEE EARVTVV | 37.17 56 |
| 948 929 907 | Autoimmune Hepatitis | Cytochrome p450 | Cytp450-1 J-p450 | SLLILLLLL NA NA | NA ILQVTSLILLLLLIKAAQ NA | 23-31 18-36 NA | NA NA DLLKNGERIEKVEGGGILQVTSLLILL LLLIKAAQ | 37.33 57 |
| 930 931 908 | Systemic Lupus erythematosus | RNA polymerase | RNAp.1 J-RNAP.1 | PGGYFIVKG NA NA | NA ECPLDPGGYFIVKGVEKVI NA | 106-115 101-120 NA | NA NA DLLKNGERIEKVEGGGECPLDPGGYFI VKGVEKVI | 37.7.1 58 |
| 949 932 909 | Systemic Lupus erythematosus | RNA polymerase | RNAP.2 J-RNAP.2 | GEMERDCLI NA NA | NA GGLRLGEMERDCLIGYGAS NA | 990-998 985-1003 NA | NA NA DLLKNGERIEKVEGGGGGLRLGEMERD CLIGYGAS | 37.7.1 58 |
| 933 934 910 | Systemic Lupus erythematosus | Histone | Hist1 J-Hist1 | APAAPAAPA NA NA | NA MSETAPAAPAAPAEKT NA | 6-13 1-18 NA | NA NA DLLKNGERIEKVEGGGMSETAPAAPAA PAPAEKT | 37.7.2 59 |
| 935 936 911 | Systemic Lupus erythematosus | anRNPs | anRNP.1 J-RNO1 | GGRGGGGG NA NA | NA GGGFRGGRGGGGGGFRGGR NA | 195-203 190-208 NA | NA NA DLLKNGERIEKVEGGGGGGFRGGRGGG GGGFRGGR | 37.7.3 60 |
| 937 938 912 | Rheumatic Fever | Myosin | My2 J-My2 | LDSKSLKI NA NA | NA IPKNLLDSKLKIISMTL NA | 794-802 789-807 NA | NA NA DLLKNGERIEKVEGGGIPKNLLDSKSL KIISMTL | 37.20 61 |
| 939 940 913 | Rheumatic Fever | Myosin | My3 J-My3 | NRIIHRDVK NA NA | NA QHLHNNRIIHRDVKGNNIL NA | 150-158 145-163 NA | NA NA DLLKNGERIEKVEGGGIQHLHNNRIIH RDVKGNNIL | 37.20 62 |
| 941 942 914 | Graves disease | Thyroid hormone | T4T J-T4R | SKSRSRSRS NA NA | NA RSRSFSKSRSRSRSLSRSR NA | 28-36 23-41 NA | NA NA DLLKNGERIEKVEGGGIRSRSFSKSRS RSRSLSRSR | 37.13 63 |

TABLE 1-continued

Autoimmune related antigens and example LEAPS™ heteroconjugates

| Seq ID No. | Disease | Protein Candidates | Abbreviation | Core epitope | Extended region | Amino acid position | J LEAPS conjugate | Ref. |
|---|---|---|---|---|---|---|---|---|
| 943 | Systemic sclerosis | DNA topoisomerase | DNAtp1 | GGKDAASPR | NA | 812-820 | NA | 37.15 |
| 944 | | | | NA | GTRLHGGKDAASPRYIFTM | 807-825 | NA | 64 |
| 915 | | | J-DNAtp1 | NA | NA | NA | DLLKNGERIEKVEGGGIGTRLHGGKDAASPRYIFTM | |
| 945 | Goodpasture's syndrome | Type IV Collaagen | C-IVp1 | GAVGPAGPP | NA | 192-200 | NA | 37.18 |
| 946 | | | | NA | APGFPGAVGPAGPPGLQGP | 187-205 | NA | 65 |
| 916 | | | J-CIVp1 | NA | NA | NA | DLLKNGERIEKVEGGGIAPGFPGAVGPAGPPGLQGP | |

Alternatively, the invention contemplates a variable immunomodulatory peptide construct having the Formula (III)

$$P_3\text{-x-}P_4 \tag{III}$$

where P3 is a peptide construct comprised of X1 to X14 said peptide P3 being associated with an antigen from Table 1, and P4 is a peptide construct comprised of X1 to X14 causing a Th1 directed immune response by said set or subset of T cells to which the peptide P3 is attached or which binds to a dendritic cell or T cell receptor causing said set or subset of DC or T cells to which the peptide P3 is attached to initiate and complete, an immune response.

Alternatively, the invention contemplates a variable immunomodulatory peptide construct having the formula (IV)

$$P_5\text{-x-}P_6 \tag{IV}$$

where $P_5$ is a peptide construct comprised of $X_1$ to $X_{14}$ said peptide $P_5$ being associated with an antigen from Table 1, and $P_6$ is a peptide construct comprised of $X_1$ to $X_{14}$ causing a $T_h1$ directed immune response by said set or subset of T cells to which the peptide $P_5$ is attached or which binds to a T cell receptor causing said set or subset of T cells to which the peptide $P_5$ is attached to initiate an immune response, such that $X_1$ to $X_{10}$ and $X_{14}$ describe a group of amino acids based on their features and $X_{11}$ to $X_{13}$ describe modifications to the peptide construct, wherein $X_1$ is selected from the group consisting of Ala and Gly,
$X_2$ is selected from the group consisting of Asp and Glu,
$X_3$ is selected from the group consisting of Ile, Leu and Val,
$X_4$ is selected from the group consisting of Lys, Arg and His,
$X_5$ is selected from the group consisting of Cys and Ser,
$X_6$ is selected from the group consisting of Phe, Trp and Tyr,
$X_7$ is selected from the group consisting of Phe and Pro,
$X_8$ is selected from the group consisting of Met and Nle,
$X_9$ is selected from the group consisting of Asn and Gln,
$X_{10}$ is selected from the group consisting of Thr and Ser,
$X_{11}$ is $Gaba^Z$ where $X_2X_3$, $X_3X_2$, $X_2X_3$, $X_3X_2$, $X_3X_3$, or $X_2X_2$ can be substituted with $X_{11}$;
$X_{12}$ is selected from the group consisting of acetyl, propionyl group, D glycine, D alanine and cyclohexylalanine;
$X_{13}$ is 5-aminopentanoic where any combination of 3 to 4 amino acids of $X_2$ and $X_3$ can be replaced with $X_{13}$;
$X_{14}$ is selected from the group consisting of $X_1$, $X_2$, $X_3$, $X_4$, $X_5$, $X_6$, $X_7$, $X_8$, $X_9$ and $X_{10}$; and
x is a direct bond or linker for covalently bonding $P_5$ and $P_6$. For example, a variable immunomodulatory peptide construct of formulae (III)-(IV) can contain a peptide causing a $T_h2$ directed immune response related to peptide J (SEQ ID No. 49), such as $X_2X_3X_3X_4X_9X_1X_2X_4X_3X_2X_4X_3X_2$ (SEQ ID No. 1091). One having skill in the art would recognize that each of $X_1$ to $X_{14}$ represents a group of amino acids having similar charge, polarity, hydrophobicity, chemical functionality, size and/or shape. As such, one having skill in the art will recognize that a variable immunomodulatory peptide can be identified by substituting a specific amino acid residue in any sequence disclosed herein with the corresponding group $X_1$ to $X_{14}$ including and representing the properties of that specific residue. For example, one having skill in the art will recognized that a Gly residue can be represented by group $X_1$, and Trp residue can be represented by $X_6$ and an Arg residue can be represented by group $X_4$. As such, one having skill in the art will be able to unambiguously assign the tripeptide GWR as $X_1X_6X_4$. Similarly, one having skill in the art will be able to unambiguously assign any of the sequences disclosed herein to a variable immunomodulatory peptide construct having residue represented by $X_1$ to $X_{14}$. For peptide ENVGSNK (SEQ ID No. 59) can be converted to the variable immunomodulatory peptide $X_2X_9X_3X_1X_8X_9X_4$ (SEQ ID No. 60) that can be incorporated into an immunomodulatory peptide construct.

Table 2 shows exemplary antigens that can be employed as peptide $P_2$ in certain embodiments for the treatment of cancer. LEAPS™ heteroconjugates consistent with Formulae (I) and (II) can be formed by combining any permutation of ICBL peptide including CEL-1000. Peptide J and/or Peptide G (Peptides $P_1$) with an antigen peptide (Peptide $P_2$) as presented in Table 2. Table 2 lists antigen sequences grouped by class of cancer that such sequences are associated with. Specifically, the first column of Table 2 list the SEQ ID No. for the sequence presented in each row. The second column lists the disease or cancer for which the sequencers presented in each row relate. The third column specifies the protein from which individual amino acid sequences are derived. The fourth column gives the abbreviation for which the sequence presented in each row can be referred to. For example, AFP stands for alpha fetoprotein, whereas J-AFP indicates a LEAPS™ heteroconjugate having the ICBL Peptide J linked to AFP. Also provided on Table 2 are example LEAPS™ heteroconjugates where Peptide $P_1$ is Peptide J (SEQ ID No. 49) combined with an antigen Peptide $P_2$. The fifth column specifies the core epitope sequence, if any, for the protein described in each row, and the sixth column specifies an extended epitope sequence associated with the protein described in each row or alternatively a LEAPS™ heteroconjugate containing Peptide J (SEQ ID No. 49). The seventh column indicates the range of amino acids from the described protein corresponding to the epitope sequence. The eighth column lists any know references describing the extended or core epitope sequences, if known. References are specified by a number corresponding to the list of references found at the end of this disclosure.

The LEAPS™ heteroconjugates presented on Table 2 are conjugates where Peptide $P_1$ is Peptide J (SEQ ID No. 49) combined with an antigen Peptide $P_2$. Those skilled in the art will recognize that other constructs can be formed substituting for Peptide $P_1$ and Peptide $P_2$ where the examples on Table 2 are merely illustrative and are not limiting.

TABLE 2

Cancer related sequences and example LEAPS™ heteroconjugates

| Seq ID No. | Disease | Protein | Abbreviation | Core epitope | Extended region or LEAPS™ heteroconjugates | Position | Reference |
|---|---|---|---|---|---|---|---|
| 967 | Colorectal cancer | NSFL1 (p97) cofactor (p47) | NSFL1.1ext | ASSSILINESEPTTNIQIR | NA | 283-301 | 110 |
| 1045 | | | J-NSFL1.1ext | NA | DLLKNGERIEKVEGGASSSILINESEPTTNIQIR | NA | |
| 968 | Colorectal cancer | ATP-binding cassette, sub family F | ATP-bcsF | FAALDEEDKEEEIK | NA | 193-209 | 110 |
| 1046 | | | J-ATP-bcsFpext | NA | NA | NA | |
| 969 | Colorectal cancer | | Nek7 | QLVNMCMNPDPEK | NA | 269-281 | 110 |
| 1047 | | | J-Nek7ext | NA | DLLKNGERIEKVEGGQLVNMCMNPDPEK | NA | |
| 970 | Colon cancer | carcinoembryonic antigen | CEA1 | YLSGANLNL | NA | 653-667 | 90 |
| 1013 | | | CEA1ext | NA | PPDSSYLSGANLNLSCHSA | 548-672 | 97 |
| 1048 | | | J-CEA1ext | NA | DLLKINGERIEKVEGGPPDSSYLSGANLNLSCHSA | NA | |
| 971 | Colon Cancer | carcinoembryonic antigen | CEA2 | YACFVSNLATGRNNS | NA | 653-667 | Kobatyashi |
| 1014 | | | CEA2ext | NA | NNNGTYACFSNLATGRNNSIVKSI | 648-672 | 128 |
| 1049 | | | J-CEA2ext | NA | DLLKINGERIEKVEGGGNNNGTYACFVSNLATGR NNSIVKSI | NA | |
| 972 | Liver cancer | Alpha fetoprotein | AFP | GVALQTMKQ | DLCQAGVALQTMKQEFLIN | 542-550 | 83 |
| 1015 | | | AFPext | NA | | 537-555 | 96 |
| 1050 | | | J-AFPext | NA | DLLKNGERIEKVEGGGDLCQAGVALQTMKQEFLIN | NA | |
| 973 | Breast cancer | Her2/Neu protein | Her2/Neu1 | KIPGSLAFL | NA | 369-337 | 85, 88 |
| 1016 | | | Her2Neu1ext | NA | FAGCKKIFSLAFLPESFD | 364-382 | 98 |
| 1051 | | | J-HerNeu1ext | NA | DLLKINGERIEKVEGGGFAGCKKIFGSLAFLPESFD | NA | |
| 974 | Breast cancer | Her2/Neu protein | Her2/Neu2 | RLLQETELIV | NA | 689-697 | 89, 88 |
| 1017 | | | Her2Neu2ext | NA | KYTMRRLLQETELVEPLTP | 684-702 | 98 |
| 1052 | | | J-Her2Neu2ext | NA | DLLKNGERIEKVEGGGKYTMRRLLQETELVEPLTP | NA | |
| 975 | Breast cancer | Her2/Neu protein | Her2/Neu3 | ALCRWGLLL | NA | 5-13 | 109 |
| 1018 | | | Her2Neu3ext | NA | MELAAICRWGLLLALLPP | 1-18 | 115 |
| 1053 | | | J-Her2Neu3ext | NA | DLLKNGERIEKVEGGGMELAALCRWGLLLALLPP | NA | |
| 976 | Breast cancer | Her2/Neu protein | Her2/Neu4 | HLYQGCQVV | NA | 48-56 | 109 |
| 1019 | | | Her2Neu4ext | NA | LDMLRHLYQGCQVVQGNLE | 43-61 | 115 |
| 1054 | | | J-Her2Neu4ext | NA | DLLKNGERIEKVEGGGLDMLRHLYQGCQVVQGNLE | NA | |
| 977 | Breast cancer | Her2/Neu protein | Her2/Neu6 | YLVPQQGFFC | NA | 1023-1032 | 109 |
| 1020 | | | Her2Neu6ext | NA | VDAEEYLIVPQQGFFCPDPAP | 1018-1037 | 116 |
| 1055 | | | J-Her2Neu6ext | NA | DLLKNGERIEKVEGGVDAEEYLIVPQQGFFCPDPAP | NA | |

TABLE 2 -continued

Cancer related sequences and example LEAPS ™ heteroconjugates

| Seq ID No. | Disease | Protein | Abbreviation | Core epitope | Extended region or LEAPS ™ | Position | Reference |
|---|---|---|---|---|---|---|---|
| 978 1021 1056 | Breast | | Her2/Neu7 Her2Neu7ext J-Her2Neu7ext | VPIKWMALWSILRRRF NA NA | NA ADGGKVPIKWMALWSILRRRFTHQSD DLLKNGERIEKVEGGADGGKVPIKWMALWSIL RRRFTHQSD | 183-198 178-203 NA | Hilthold 120 |
| 979 1022 1057 | Breast Ovarian | Mucin 1 | Muc1 Muc1ext J-Muc1ext | STAPPAHGV NA NA | NA STAPPAHGVSTAPPAHGV DLLKNGERIEKVEGGSTAPPAHGVSTAPPAHGV | NA NA NA | 84 105 |
| 980 1023 1058 | Breast Ovarian | Mucin 2 | Muc2 Muc2ext J-Muc2ext | LLNQLQVNL NA NA | NA SDGVLLNQLQVNLPHVTA DLLKNGERIEKVEGGSDGSVLLNQLQVNLPHVTA | 467-475 462-480 NA | 106 |
| 981 1024 1059 | Cervical cancer | E7 protein of human papiloma virus Type 16 | HPV16E7.1 J-HPV16E7.1ext | DRAHYNIVTFCCK NA | GQAEPDRAHYNIVTFCCKDSTL DLLKNGERIEKVEGGGQAEPDRAHYNIVTFCC KCDSTL | 48-60 43-65 NA | 87 99 |
| 982 1025 1060 | Cervical Cancer | HPV 52 | HPV 52 L1.1 HPV52L1.1ext J-HPV52L1.1ext | STYKNENFK NA NA | NA EVKKESTYKNENFKEYLRH DLLKNGERIEKVEGGGEVKKESTYKNENFKEYLRH | 383-391 378-396 NA | 114 118 |
| 983 1026 1061 | Cervical Cancer | HPV 52 | L1.2 L1.2ext J-HPV52L1.2ext | SAPRTSTKK NA NA | NA KRPASSAPRT STKKKKVKR DLLKNGERIEKVEGGGKRPASSAPRT STKKKKVKR | 516-524 511-529 NA | 114 118 |
| 984 1027 1062 | Cervical Cancer | HPV52 | L1.3 L1.3ext J-HPV52L1.3ext | TSESQLFNK NA NA | NA SGSMVTSESQLFNKPYWLQ DLLKNGERIEKVEGGSGSMVTSESQLFNKPYWLQ | 332-340 327-345 NA | 114 118 |
| 985 1028 1063 | Cervical Cancer | HPV 16 | HPV E6.1 HPV16E6.1ext J-HPV16E6.1ext | KTLEERVKK NA NA | NA YSLYGTLEERVKKPLSEI DLLKNGERIEKVEGGSGSYSLYGKTLEERVKKP LSIE | 86-94 81-99 NA | 114 119 |
| 986 1029 1064 | Cervical Cancer | | HPV E6.2 HPV16E6.2ext J-HPV16E6.2ext | RLQCVQCKK NA NA | NA SVHEIRLQCVQCKKELQRR DLLKNGERIEKVEGGSGSVHEIRLQCVQCKKEL QRR | 27-35 22-40 NA | 114 119 |
| 987 1030 1065 | Cervical Cancer | HPV16 | HPV E6.3 HPV16E6.3ext J-HPV16E6.3ext | ILIRCIICQ NA NA | NA KPLSEILIRCIICQTPLCP DLLKNGERIEKVEGGSKPLSEILIRCIICQTPLCP | 99-107 94-112 NA | 114 119 |

TABLE 2 -continued

Cancer related sequences and example LEAPS™ heteroconjugates

| Seq ID No. | Disease | Protein | Abbreviation | Core epitope | Extended region or LEAPS™ | Position | Reference |
|---|---|---|---|---|---|---|---|
| 988 | Cervical Cancer | HPV16 | HPV E7.2 | YMLDLQPETT | NA | 11-20 | 121 |
| 1031 | | | HVP16E7.2ext | NA | PTHEYMLDLQPETTDLYCY | 6-25 | |
| 1066 | | | J-HPV16E7.2est | NA | DLLKNGERIEKVEGGGPTLHEYMLDLQPETTDLYCY | NA | |
| 989 | Several | Oncofetal antigen immature lamin receptor | OFA-ILR1 | LLAARAIVAI | NA | 59-68 | 93 |
| 1032 | | | OFA-ILR1ext | NA | TWEKLLLAARAIVAIENPAD | 54-73 | 100 |
| 1067 | | | J-OFA-ILR1ext | NA | DLLKNGERIEKVEGGGTWEKLLLAARAIVAIENPAD | NA | |
| 990 | Several | Oncofetal antigen immature lamin receptor | OFA-ILR2 | ALCNTDSPL | NA | 146-154 | 93 |
| 1033 | | | OFA-ILR2ext | NA | NLPTIALCNTDSPLRVDI | 141-159 | 100 |
| 1068 | | | J-OFA-ILR2ext | NA | DLLKNGERIEKVEGGGNLPTIALCNTDSPLRVDI | NA | |
| 991 | Prostate Cancer | Prostatic acid phosphatase | PAP1 | ILLWQPIPV | NA | 135-143 | 91 |
| 1034 | | | PAP1ext | NA | SIWNPILLWQPIPVHTVPL | 130-148 | 103 |
| 1069 | | | J-PAP1ext | NA | DLLKNGERIEKVEGGGSIWNPILLWQPIPVHTVPL | NA | |
| 992 | Prostate Cancer | Prostate Specific Antigen | PSA1 | KLQCVDLHV | NA | 146-154 | 91 |
| 1035 | | | PSA1ext | NA | FLTPKKLQCVDLHVISNDV | 141-159 | 104 |
| 1070 | | | J-PSA1ext | NA | DLLKNGERIEKVEGGGFLTPKKLQCVDLHVISNDV | NA | |
| 993 | Prostate | | PSA Peptide2 | FLRPGDSSHDLNLLR | NA | 110-125 | 113 |
| 1071 | | | J-PSA1 | NA | DLLKNGERIEKVEGGGFLRPGDSSHDLNLLR | NA | |
| 994 | Prostate | | PAP2 | FQELESETLKSEEFQK | NA | 164-179 | 113 |
| 1072 | | | J-PAP2ext | NA | DLLKNGERIEKVEGGGFQELESETLKSEEFQK | NA | |
| 995 | Prostate | | Periostin pep | GLESNVNELLNALHSHMNKR | NA | 152-173 | 113 |
| 1073 | | | J-Perpep | NA | DLLKNGERIEKVEGGGLESNVNELLNALHSHMNKR | NA | |
| 996 | Melanoma | Melanoma-associated antigen 2 | MA2 | REPVTKAEML | NA | 127-136 | 91, 95 |
| 1036 | | | MA2ext | NA | LLKYRAREPVTKAEMLGSVVGNWQ | 122-141 | 101 |
| 1074 | | | J-MA2ext | NA | DLLKNGERIEKVEGGGLLKYRAREPVTKAEMLGSVVGNWQ | NA | |
| 997 | Melanoma | Melanoma-associated antigen 3 | MA3 | EVDPIGHLY | NA | 168-176 | 86, 82 |
| 1037 | | | MA3 ext | NA | GIELMEADPIGHLYIPATC | 163-181 | 102 |
| 1075 | | | J-MA3ext | NA | DLLKNGERIEKVEGGGIELMEADPIGHLYIPATC | NA | |
| 998 | Melanoma | Tyrosinase-Related Protein 2 | TRP2 | SVVDFFVWL | NA | 180-188 | 92 |
| 1038 | | | TRP2ext | NA | FANCSSVYDFFVWLHYYSV | 175-193 | 107 |
| 1076 | | | J-TRP2ext | NA | DLLKNGERIEKVEGGGFANCSSVYDFFVWLHYYSV | NA | |
| 999 | Melanoma | Tyrosinase-Related Protein 2 | TRP1 | MSLQRQFLR | NA | NA | 108 |
| 1039 | | | TRP1ext | NA | MSLQRQFLRTQLWD | NA | 108 |
| 1077 | | | J-TRP1ext | NA | DLLKNGERIEKVEGGGMSLQRQFLRTQLWD | NA | |

TABLE 2-continued

Cancer related sequences and example LEAPS™ heteroconjugates

| Seq ID No. | Disease | Protein | Abbreviation | Core epitope | Extended region or LEAPS™ | Position | Reference |
|---|---|---|---|---|---|---|---|
| 1000 1040 1078 | Lung cancer | C3dg Complement | C3dg1 C3dg1ext J-C3dg1ext | AGDFLEANYMNLQR NA NA | NA GSITAGDFLEANYMNLQRSYTVA DLLKNGERIEKVEGGGSITKAGDFLEANYMNLQR SYTVA | 1172-1185 1167-1190 NA | 111 117 |
| 1001 1079 | Lung cancer | C3dg Complement | C3dg2ext Complement J-C3dg2ext | ILLQGTPVAQMTEDAVDAER NA | NA DLLKNGERIEKVEGGGILLQGTPVAQMTEDAVDAER | 980-999 NA | 111 117 |
| 1002 1041 1080 | Lung cancer | C3dg Complement | C3dg3 C3dg3ext J-C3dg3ext | KGYTQQLAFR NA NA | NA LELIKKGYTQQLAFRQPSSA DLLKNGERIEKVEGGGKGYTQQLAFR | 1051-1060 1046-1065 NA | 111 117 |
| 1003 1042 1081 | Lung cancer | C3dg Complement | C3dg4 C3dg4ext J-C3dg4ext | QPSSAAFAAFVKR NA NA | NA QLAFRQPSSAFAAFVKRAPSTW DLLKNGERIEKVEGGQLAFRQPSSAFAAFVKRA PSTW | 1061-1072 1056-1077 NA | 111 117 |
| 1004 1043 1082 | Lung cancer | C3dg Complement | C3dg4 C3dg4ext J-C3dg4ext | WLNEQR NA NA | NA PPVVRWLNEQRYYGGG DLLKNGERIEKVEGGGPPVVRMLNEQRYYGGG | 1255-1260 1250-1265 NA | 111 117 |
| 1005 1083 | Lung cancer | | C9 PEPTIDE a J-C9a | FTPTENKAEQCCEETASSISLHG NA | NA DLLKNGERIEKVEGGGFTPTENKAEQCCEETAS SISLHG | 243-267 NA | 111, 129 |
| 1006 1084 | Lung cancer | | C9 PEPTIDE b J-C9b | QYTGTSYDPELTESSGSASHIDC NA | NA DLLKNGERIEKVEGGQYTGTSYDPELTESSGSA SHIDC | 22-44 NA | 111, 129 |
| 1007 1085 | Gastric (Stomach) Cancer | Pepsinogen | pep1 | FLKKHNLNPARKYFPQW | NA | 41-57 | 111, 130 |
| 1008 1086 | Gastric (Stomach) Cancer | Pepsinogen | J-Pep1 | NA | DLLKNGERIEKVEGGGFLKHNLNPARKYFPQW | NA | 111, 130 |
| 1008 1086 | Gastric (Stomach) Cancer | Pepsinogen | pep2 | FLKKHNLNPARKYFPQWEA | NA | 41-59 | 111, 130 |
|  | Gastric (Stomach) Cancer | | J-Pep2 | NA | DLLKNGERIEKVEGGGFLKKHNLNPARKYFPQWEA | NA | |
| 1009 1087 | Gastric (Stomach) Cancer | Leucine zipper protein | LZpf J-LZpf | ETKKTEDRFVPSSSKSEGKKSR EQPSVLSR NA | NA DLLKNGERIEKVEGGGETKKTEDRFVPSSSKSEG KKSREQPSVLSR | 447-476 NA | 112, 131 |
| 1010 | Gastric (Stomach) Cancer | albumin fragment | | DAHKSEVAHRFKDLGEENFKA LVL | NA | 25-48 | 112, 132 |

TABLE 2-continued

Cancer related sequences and example LEAPS™ heteroconjugates

| Seq ID No. | Disease | Protein | Abbreviation | Core epitope | Extended region or LEAPS™ | Position | Reference |
|---|---|---|---|---|---|---|---|
| 1088 | | | J-Albfrag | NA | DLLKNGERIEKVEGGGDAHKSEVAHRFKDLGEENF KALVL | NA | |
| 1011 | Gastric (Stomach) Cancer | a1antitryposin | a1Try1 | SIPPEVKFNKPFVFLIEQNTKS PLFMGKVVNPTQK | NA | 369-404 | 112, 132 |
| 1089 | | | J-a1Try1 | NA | DLLKNGERIEKVEGGGSIPPEVKFNKPFVFLIEQN TKSPLFMGKVVNPTQK | NA | |
| 1012 | Testes Tumor | | NY-ESQ1 | LSLLMWITQCFLPVFLA | NA | 156-172 | Zeng, 134 |
| 1044 | | | NY-ESQ11 | NA | SCLQQLSLLMWITQCLFLPVFLAQPPSG | 151-177 | 134 |
| 1090 | | | J-ESQ1 | NA | DLLKNGERIEKVEGGGSCLQQLSLLMWITQCLFLP VFLAQPPSG | NA | |

Reversal Sequences

Embodiments also contemplate reversal sequences where the order of amino acids in Peptides $P_1$, $P_2$, $P_3$, $P_4$, $P_5$ and $P_6$ is reversed from N-term to C-terminus. For example peptide J has the sequence DLLKNGERIEKVE (SEQ ID No. 49). The reversal sequence of SEQ ID No. 49 has the sequence from N-terminus to C-terminus of EVKEIREGNKLLD. The reversal sequence for any ICBL disclosed herein is envisioned for inclusion in a LEAPS™ heteroconjugate as described herein. Further, the non-reversal sequence for an ICBL can be conjugated with an antigen sequence from Table 1 or with a reversal antigen sequence from Table. The reversal sequence for SEQ ID No. 1 is EGKPGQEGKFGAI, such that LEAPS™ heteroconjugates contemplated in certain embodiments include DLLKNGERIEKVEGGGEGKPGQEGKFGAI and DLLKNGERIEKVEGGGIAGFKGEQGPKGE, were Peptide J (SEQ ID No. 49) is conjugate with the reversal sequence of SEQ ID No. 1 or the non-reversal sequence of SEQ ID No. 1, respectively. Further, the reversal sequence for an ICBL can be conjugated with an antigen sequence from Table 1 or with a reversal antigen sequence from Table 1. Such LEAPS™ heteroconjugates contemplated in certain embodiments include EVKEIREGNKLLDGGGEGKPGQEGKFGAI and EVKEIREGNKLLDGGGIAGFKGEQGPKGE, where the reversal sequence for Peptide J (SEQ ID No. 49) is conjugate with the reversal sequence of SEQ ID No. 1 or the non-reversal sequence of SEQ ID No. 1, respectively.

Methods of Treating a Subject with LEAPS™ Heteroconjugates

Any of the LEAPS™ heteroconjugates in accordance with Formulae (I)-(IV) described above can be combined with an appropriate pharmaceutically suitable carrier with one or more optional adjuvants for administration to a subject. Such combination of the LEAPS™ heteroconjugates and a pharmaceutically suitable carrier can function to modulate an immune response as outlined for any of the autoimmune related conditions on Table 1 or can function as a vaccine to confer immune resistance to a broad spectrum of cancers as outline in Table 2. For example, an immunomodulatory peptide constructs having any of SEQ ID No. 291, 293, 315, 317, 319, 325, 331, 339, 341, 347, 355, 782, 786, 804, 828, 856-866, 867-879, 881, 883-884, 886-895, 897, 899-904, 906-916 and 964-966 or a variant thereof or another LEAPS™ heteroconjugate containing any of the described Peptides $P_1$ and an antigen sequence from Table 1, individually or as a mixture thereof, can be combined with a pharmaceutically suitable carrier to form a composition for modulating an immune response. Similarly, an immunomodulatory peptide constructs having any of SEQ ID No.'s 1045-1090 or a variant thereof or another LEAPS™ heteroconjugate containing any of the described Peptides $P_1$ and an antigen sequence from Table 2, individually, or as a mixture thereof, can be combined with a pharmaceutically suitable carrier to form a vaccine composition.

LEAPS™ technology directly mimics cell to cell interactions on the dendritic and T-cell surfaces using synthetic peptides. The LEAPS™ heteroconjugates containing the antigenic epitope linked to an ICBL can be manufactured by peptide synthesis or by covalently linking two peptides. Depending on the type of LEAPS™ heteroconjugates and ICBL used, the peptide construct is able to direct the outcome of the immune response towards the development of T-Cell function with primary effector T-cell functions: T Lymphocyte: helper/effector T Lymphocyte, type 1 or 2 (Th1 or Th2), cytotoxic (Tc) or suppressor (Ts) without excessive amounts of proinflammatory and inflammatory cytokines.

The type of the immune response elicited against an immunogen or a natural infection can be classified as Th1/Tc1, Th2/Tc2 or Th3 based on the predominant IgG subtype, the cytokines that are induced, or the presence or absence of delayed type hypersensitivity (DTH) response. A Th0 response is an earlier response that can mature into either a Th1 or a Th2 response and has features of both. The Th1 (CD4)/Tc1 (CD8) response is characterized by activation of $CD4^+$ and $CD8^+$ T cells to produce IL-2, TNF-β, and IFN-γ and to promote the production of IgM and specific IgG antibody subtypes and cell-mediated immune responses including delayed-type hypersensitivity (DTH). These response reinforce early, local and inflammatory responses. Th2 responses promote different IgG subclasses, IgE and IgA responses but not cell mediated responses to antigen (Ag). Th2 responses prevent the onset of protective Th1 cell mediated responses important for infection control, which may exacerbate disease. Initiation of Th1 and Th2 responses has important implications in terms of resistance and susceptibility to disease. Th1-dominated responses are potentially effective in eradicating infectious agents, especially viruses and intracellular infections, and are important for the induction of cytotoxic T lymphocytes (CTL). In contrast, a Th2 response is insufficient to protect against challenge with intracellular infections, but can provide protection against parasite and extracellular agents that can be neutralized by antibodies and against autoimmunity. Most importantly, for many vaccine it is thought that initiation of immunity with a Th1 response and then progression to a Th2 response promotes better immune memory.

Many suitable pharmaceutical carriers are known to persons, skilled in the art. The primary function of the pharmaceutical carrier is to assist in the delivery and/or administration the immunomodulatory peptide construct to a subject. The pharmaceutical carrier can be as simple as sterilized water. In certain embodiments, the pharmaceutical suitable carrier is a sterile pyrogen-free formulation containing from about 0.2 mg/mL to about 10 mg/mL of the immunomodulatory peptide construct in phosphate-buffered saline (PBS) and trehalose or other sugar that has been lyophilized to remove water and reconstituted prior to use with sterilized water for injection to a subject.

Optional adjuvants include products such as GMP products including Montanide ISA-51 (Seppic, Fairfield, N.J.), Depovax, a patented liposomal adjuvant currently in phase I trials by Immunovaccine Technologies, and MASI, a proprietary water-in-oil GMP adjuvant from MerciaPharma currently in phase II clinical studies. Alum is currently the only FDA licensed adjuvant of the group. In certain embodiments, the composition administered to a subject containing a LEAPS™ heteroconjugate, as described herein, has mixture of an aqueous phase and an adjuvant oil phase from about 1:4 to about 4:1.

A composition having the LEAPS™ heteroconjugate and a suitable pharmaceutical carrier with or without an optional adjuvant can be administered to a subject by subcutaneous or intramuscular injection in a therapeutically effective amount. The subject can be a mammal subject including a human subject.

Freund's Incomplete Adjuvant is also contemplated (Sigma Corp., St. Louis, Mo.). For Product Number F5506, the Storage Temperature is 2-8° C. where F5881 is a clear, amber liquid containing particulate matter (dried cells). F5506 is a clear amber liquid. Freund's incomplete Adjuvant is one of the most commonly used adjuvants in research. It is used as a water-in-oil emulsion. It is prepared from non-metabolizable oils (paraffin oil and mannide monooleate). First developed by Jules Freund in the 1940's, Freund's Adjuvant is designed to provide continuous release of antigens necessary for stimulating a strong, persistent immune response. The main disadvantage of Freund's Adjuvant is that it can cause granulomas, inflammation at the inoculation site and lesions. To minimize side-effects, Incomplete Freund's Adjuvant is used for the boosts. (Freund, J. and McDermott, K., Proc. Soc. Exp. Biol. Med., 1942: 49:548-553; Freund, J. Ann. Rev. Microbiol., 1947: 1:291; Freund, J., Adv. Tuberc. Res., 1956: 7:130; Bennett, B. et al., J. Immuno. Meth., 1992: 153:31-40; Deeb, B. J. et al., J. Immuno. Meth., 1992: 152:105-113; Harlow, E. and Lane, D., Antibodies: A Laboratory Manual, Cold Spring Harbor Laboratory, 1988).

Maturation of Dendritic Cells with LEAPS™ Heteroconjugates

In certain embodiments, a subject's immune response is modulated by being administered DCs matured and activated in the presence of a LEAPS™ heteroconjugate consistent with Formulae (I) or (II), or alternatively a LEAPS™ heteroconjugate consistent with Formulae (III) or (IV). Modulation of an immune response required mimicking nature's approach to recognition of antigens. DCs play a major role in initiating and directing the immune response to an antigen. The initial host response to an antigen requires internalization of the antigen into the DC followed by processing and presentation by the MHC I or II proteins for T cell recognition. DCs, macrophages and B cells are capable of presenting antigens to $CD4^+$ helper T cells and $CD8^+$ cytotoxic T cells as peptides held within grooves of the class II and I MHC proteins, respectively. These cells can be functionally divided into DC1 and DC2 cell types based on the means of their activation, their cytokine output and the nature of their influence on T cells. DC1 cells product IL12 and promote Th1-type responses whereas DC2 cells promote Th2-type responses.

As described above, the LEAPS™ heteroconjugates described herein can be administered to a subject to modulate an immune response in vivo. The immunomodulatory peptide constructs can also modulate the properties of immune cells, including DCs, ex vivo, in order to activate, mature, and direct the character and phenotype of immune cells, (e.g. DCs) contacted with the LEAPS™ heteroconjugate. Such treated immune cells, which can include DCs and/or monocytes, can then be introduced into a subject for the purpose of modulating an immune response in an autoimmune condition, DCs treated with a LEAPS™ heteroconjugate ex vivo and transferred to a subject can confer acquired immunity to the subject. As used herein, the term ex vivo means that the LEAPS™ heteroconjugate is contacted with living cells outside of the subject's body.

In certain embodiments, DCs and/or monocytes are extracted from a subject or donor away from other tissues of the body. The dendritic cells and/or monocytes are then contacted with one or more LEAPS™ heteroconjugates. DCs and/or monocytes isolated from a subject or donor can be in an immature state characteristic of immune cells prior to contact with an antigen. Such cells are herein referred to as immature DCs (iDCs). The DCs and/or monocytes can be isolated from blood derived monocytes and/or bone marrow taken from a subject or donor. DCs and/or monocytes expressly include monocyte cells capable of differentiating into macrophages and/or dendritic cells that can function to present antigens to T cells under appropriate conditions.

Upon contact or treatment of the isolated dendritic cells and/or monocytes with the LEAPS™ heteroconjugates, the dendritic cells and/or monocytes undergo a maturation to a state that directs and/or modulates an immune response.

As defined herein, the term "immature DCs" (iDCs) refers to cells derived from a donor or subject that are not competent to induce T cell activation upon interaction with T cells. Such iDCs are also known in the art as naïve DCs. Such iDCs can have certain physical characteristics such as a reduced level of expression of CD80 and/or CD86, MHC molecules (class I and/or class II), other surface markers and a reduced appearance of dendrites. Immature DCs, as defined herein, expressly includes monocytes that can be stimulated to form dendritic cells. As defined herein, terms "matured DCs" and "more matured DCs" refer to DCs after contact with any of the LEAPS™ heteroconjugates described herein. Such matured DCs can have certain physical characteristics including upregulation of CD80 and/or CD86, MHC I or II molecules, an increased appearance of dendrites and secretion of IL-12p70.

In certain embodiments, contacting monocyte cells with one or more LEAPS™ heteroconjugates can induce the development of the monocyte cells or iDCs to DC1 (Th1-inducing dendritic cells) and/or DC2 cells (Th2-inducing dendritic cells) or other cell type allowing for acquired immunity when transferred to a subject. In certain other embodiments, iDCs and/or monocytes isolated from a subject or donor are contacted with a media containing granulocyte-macrophage colony stimulating factor (GM-CSF) to stimulate the expression of CD11c on the surface of the iDCs or monocytes. The iDCs and/or monocytes after exposure to GM-CSF are contacted with one or more LEAPS™ heteroconjugates to induce the maturation of the monocyte cells or iDCs to DC1 (Th1-inducing dendritic cells) and/or DC2 cells (Th2-inducing dendritic cells) or other cell type allowing for an immune response to be modulated when administered to a subject.

In certain embodiments, DCs and/or monocytes are extracted from a subject or donor away from other tissues of the body in a composition of isolated iDCs and/or monocytes. As described herein, a composition of isolated DCs and/or monocytes is composition in which the DCs and/or monocytes are present away from other body tissue including blood or bone marrow. In certain embodiments, a composition of isolated DCs and/or monocytes contains at least 50% of the viable cells present in the composition being DCs and/or monocytes. In certain embodiments, the composition of DCs and/or monocytes is substantially free from whole red blood cells.

In certain embodiments, the iDCs and/or monocytes are contacted or treated with one or more LEAPS™ heteroconjugates for about 6 hours to about 96 hours or from about 12 hours to about 72 hours. In certain other embodiments, the iDCs and/or monocytes are contacted or treated with one or more LEAPS™ heteroconjugates for a period of time longer than about 6 hours. In additional embodiments, the iDCs and/or monocytes are contacted or treated with one or more LEAPS™ heteroconjugates for a period of time longer than about 12 hours. In certain additional embodiments, the iDCs and/or monocytes are contacted or treated with one or more LEAPS™ heteroconjugates for a period of time longer than about 24 hours. In certain embodiments, the iDCs and/or monocytes are contacted or treated with one or more LEAPS™ heteroconjugates at a ratio from about 5 to about 50 micromoles of one or more LEAPS™ heteroconjugates per $10^6$ iDCs and/or monocytes. In certain other embodiments, the iDCs and/or monocytes are contacted or treated with one or more LEAPS™ heteroconjugates at a ratio greater than about 5 micromoles of one or more LEAPS™ heteroconjugates per $10^6$ iDCs and/or monocytes.

In certain embodiments, the iDCs and/or monocytes are contacted with GM-CSF for a period of about 1 day to about 10 days or from about 3 days to about 10 days. In certain additional embodiments, the iDCs and/or monocytes are contacted with GM-CSF for a period greater than about 5 days. In certain embodiments, the iDCs and/or monocytes are contacted with a media having a concentration of from about 5 to about 200 ng/mL of GM-CSF or from about 10 to about 150 ng/mL or GM-CSF. In other embodiments, the DCs and/or monocytes are contracted with a media having a concentration of GM-CSF greater than about 5 ng/mL. In certain embodiments, the DCs and/or monocytes are contacted with a media having a concentration of GM-CSF greater than about 15 ng/mL of GM-CSF.

Upon contact of iDCs and/or monocytes with the LEAPS™ heteroconjugate, an increased expression level of interleukin-12p70 (IL-12p70) can be observed relative to iDCs and/or monocytes not contacted with the LEAPS™ heteroconjugate. In certain embodiments, iDCs and/or monocytes contacted with the LEAPS™ heteroconjugate exhibit an up-regulation of at least one of the following: CD80, CD86, MHC class I, or MHC class II cell surface markers relative to iDCs and/or monocytes not contacted with the LEAPS™ heteroconjugate.

Immature dendritic cells and/or monocytes after contact with an immunomodulatory LEAPS™ heteroconjugate can be referred to as matured dendritic cells. The matured dendritic cells can modulate an immune response when administered or introduced into a subject. An immune response can be induced in a subject under situations where matured dendritic cells are washed free of LEAPS™ heteroconjugate that is unbound from the surface of a dendritic cell. As such, the amount of any antigen, including the antigen peptide $P_2$ forming part of the LEAPS™ heteroconjugate, introduced into a subject is limited.

Without wishing to be bound by any one particular theory, it is believed that the LEAPS™ heteroconjugate is retained on the surface of DCs in a manner allowing for the interaction of the LEAPS™ heteroconjugate with T cell receptor present on the surface of T cells. As such, DCs matured in the manner described above can be introduced or administered to a subject such that the LEAPS™ heteroconjugate present of the surface of the introduced or administered DCs can interact with the subject's in situ T cells to direct and/or modulate an antigen specific immune response. More specifically, activation of T cell-mediated immune response requires multiple stimulator interactions, including interaction with T cell receptor (TCR) present on the surface of T cells. It is believed that these more matured DCs having the LEAPS™ heteroconjugate present of the surface can provide the necessary interaction to activate T cells and direct an immune response to the Peptide $P_2$ antigen of the LEAPS™ heteroconjugate. Further, it is believed that these more matured DCs formed using the methods described herein have an advantageous profile of secreted cytokines that do not stimulate a cytokine storm or other delirious inflammation response in a subject.

The more matured dendritic cells and/or T cells can be used in an autologous fashion. In certain embodiments, iDCs and/or monocytes are isolated from a subject to be treated, such isolated cells can be blood derived monocytes and/or bone marrow cells taken from the subject. The isolated iDCs and/or monocytes are contacted with one or more LEAPS™ heteroconjugates having the structure $P_1$-x-$P_2$ or $P_2$-x-$P_1$ to induce maturation to more matured dendritic cells. An effective amount of the DCs are administered to the same subject from where the matured cells were originally isolated. The subject can be a mammal, including a human.

In certain other embodiments, iDCs and/or monocytes can be isolated from a compatible donor, treated with a heteroconjugate peptide having the structure $P_1$-x-$P_2$ or $P_2$-x-$P_1$ to induce maturation to form matured dendritic cells, and an effective amount of the matured dendritic cells and/or T cells administered to a subject having compatibility with the donor.

The matured DCs having been treated with the LEAPS™ heteroconjugate having the structure $P_1$-x-$P_2$ or $P_2$-x-$P_1$ can be administered to a subject either as a prophylactic or therapeutic treatment against the development of an autoimmune condition for an antigen contained in the LEAPS™ heteroconjugate, as a prophylactic or therapeutic treatment against the development of a cancer associated with an antigen contained in the LEAPS™ heteroconjugate or to modulate an existing immune response against such an autoimmune condition or cancer present in the subject.

Diagnostic Application of Dendritic Cells with LEAPS™ Heteroconjugate

Further, it is believed that the modulation of an antigen specific immune response by maturation of DCs with the LEAPS™ heteroconjugate will sensitize the matured DCs to locate and/or to target the tissues, organ systems or other structures in the body where an autoimmune event is occurring. As such, the matured DCs can be used to detect, to diagnose and/or to locate an autoimmune related condition or cancer cells. Often, detection of autoimmune related conditions or cancer required the condition to reach a relatively advanced stage such that symptoms can be observed. Here, the matured DCs treated with a LEAPS™ heteroconjugate can be used to sensitively detect early stage conditions even before the appearance of symptoms.

Matured DCs treated with a LEAPS™ heteroconjugate have a property allowing for the location of such matured DCs to the site of an autoimmune condition or cancer cells in a subject. The LEAPS™ heteroconjugate has a $P_2$ peptide sequence originating or derived from an antigen associated with of an autoimmune condition or cancer, as described above. Maturation of DCs through treatment with a LEAPS™ heteroconjugate allows for the matured DCs to collect or locate in an area of a subject's body where autoimmune related conditions (e.g. arthritic joints) or cancer cells are present. As such, an autoimmune related condition or cancer can be detected by observing matured dendritic cells administered to a subject collecting, locating or concentrating at a site within the subject's body where an undesirable immune response, such as an autoimmune response, is occurring or where cancer cells are present.

In certain embodiments, matured DCs can be labelled with a tracking marker to allow for their location within a subject's body to be tracked after administration to the subject. For example, matured DCs can be labelled with radionuclides (radioisotopes) to allow for the location of the labeled, matured DCs to be detected using appropriate equipment. Appropriate radionucleotides include radioactive isotopes of iodine such as $^{131}$I or $^{128}$I as well as other radionuclides including $^{18}$F, $^{32}$P, $^{64}$Cu, $^{90}$Y, $^{99m}$Tc, $^{124}$I, $^{89}$Zr, $^{111}$In, $^{188}$Re, or $^{177}$Lu. The location of radionucleotides can be determined using a radiation detector, single-photon tomography/computed tomography (SPECT/CT), scintillation camera, position emission tomography or photographic film sensitive to radiation. In certain further embodiments, matured DCs can be labeled with a dye, such as Cy5.5, Alexa Fluor®, carboxyfluorescein succinimidyl ester (CSFE), and other near-infrared (NIR) probes, where the presence of such dye-labelled DCs can be detected in tissues taken by biopsy from a patient administered the matured DCs. Additional NIR probes include Cy 5.5, CSFE, Alexa Fluor® dyes (Alexa), or other NIR dyes covalently linked to 4-N(S-glutathionylacetylaminophenyl)arsenoxide or 2,3-dicyanonaphthalene, such as 4-N(S-glutathionylacetylaminophenyl)aresenoxide-Cy5.5 4-N(S-glutathionylacetylaminophenyl)arsenoxide-CSFE, 4-N(S-glutathionylacetylaminophenyl)arsenoxide-Alexa, 2,3-dicyanonaphthalene-Cy5.5, and 2,3-dicyanonaphthalene-CSFE, and 2,3-dicyanonaphthalene-Alexa. In further embodiments, luminescence probes can also be conjugated to the LEAPS™ peptide construct or to LEAPS™-treated DCs. In certain embodiments, the presence of fluorescence in a tissue sample taken from a subject's body is determined by flow cytometry.

The immunomodulatory LEAPS™ heteroconjugates can be used to modulate a subject's immune system to detect the presence of an autoimmune condition at an early state. The LEAPS™ heteroconjugates can be used to mature immature DCs or monocytes isolated from the subject or a compatible donor to be sensitive to a desired antigen involved in an autoimmune related condition. Since the DCs can be manipulated outside of the body, the matured DCs can be labelled with a tracking marker in a manner allowing for sensitive detection. In particular, labelling with radionuclides can allow for detection down to very low levels.

In other embodiments, the immunomodulatory LEAPS™ heteroconjugates can be used to modulate a subject's immune system to detect the presence a cancer at an early stage. The LEAPS™ heteroconjugates can be used to mature immature DCs or monocytes isolated from the subject or a compatible donor to be sensitive to a desired antigen originating or derived from cancer cells where detection is desired. As described above, the DCs can be manipulated outside of the body and labelled with a tracking marker in a manner allowing for sensitive detection. In particular, labelling with radionuclides can allow for detection down to very low levels. Similarly, a concentrated location of a contrasting agent can be made readily apparent in an MRI image or the presence of a fluorescent or luminescent dye can be discerned at very low levels of such agents.

In certain embodiments, immature DCs and/or monocytes are collected from a subject or a compatible donor and matured by treatment or contact with a LEAPS™ heteroconjugates having a structure of Formulae (I) or (II) and incorporating an antigen peptide ($P_2$) sequence as described on Table 1. Alternatively, a LEAPS™ heteroconjugate having a structure of Formulae (III) or (IV) can also be used. The matured DCs are administered to the subject through an intravenous route or another appropriate route and a period of time is allowed to elapse. A diagnostic determination of the presence or location of an autoimmune condition can be made by observing the location of the administered matured dendritic cells and/or tracking marker. When the relevant condition is present in the body of the subject, the matured DCs and/or tracking marker will concentrate at the location, tissue type or organ structure where the autoimmune related condition is occurring or where cancer cells are present. When the targeted condition is not present, the matured DCs and/or tracking marker is expected to be diffused in different locations of the subject's body and not concentrated in any particular location, tissue type or organ structure.

The diagnostic determination can be made by only observing the location, tissue type or organ structure for which the autoimmune condition is expected to be found. For example, if matured DCs are made with a LEAPS™ heteroconjugates containing an antigen sequence derived from collagen, then only observation of presence of the matured DCs and/or tracking marker in specific joints of the body that may be affected by arthritis needs to be made. Since the amount of tracking marker administered to the subject is known, a determination of a concentration of the matured DCs and/or tracking marker in a specific location, tissue type or organ structure can be made without the need for a direct comparison with other body tissues.

In certain embodiments, a majority of the matured DCs and/or tracking marker is present in a specific location, tissue type or organ structure of the subject indicating the presence of the targeted autoimmune condition or cancer. In certain other embodiments, at least about 75% of the matured DCs and/or tracking marker are present in a specific location, tissue type or organ structure of the subject indicating the presence of the targeted autoimmune condition or cancer. In certain other embodiments, less than a majority of the matured DCs and/or tracking marker present in a specific location, tissue type or organ structure can indicate the presence of the targeted autoimmune condition or cancer when the matured DCs and/or tracking marker in the specific location, tissue type or organ structure is higher than in surrounding areas.

Labeling of Dendritic Cells and Delivery of Therapeutic Compounds

The ability of LEAPS™ heteroconjugates treated DCs to locate to the site of an autoimmune event or cancer can be utilized to deliver therapeutic agents directly to the site of the autoimmune related condition or cancer in addition to the diagnostic applications discussed above. At least a portion of the LEAPS™ heteroconjugates used to treat the DCs is expected to remain associated with the DCs. As such, the LEAPS™ heteroconjugate can be associated or conjugated to a tracking marker, such as a radioisotype, or to a therapeutic agent. For example, the LEAPS™ heteroconjugates peptide can be conjugated to monomethyl auristatin (a microtubule inhibitor), saporin, or maytansinoid 1 molecule using a cathespsin cleavable valine-citrulline (vc) dipeptide linker to a cysteine or lysine residue on the LEAPS™ heteroconjugates. The therapeutic agent or radioisotope conjugated to a LEAPS™ heteroconjugate or to an mAb can be conjugated or linked to a lysosomatropic agent. A lysosomatropic agent is a weak organic base that can diffuse through membranes but will become protonated in the lysosome of a cell, where the protonated lysomatropic agent is unable to diffuse through membranes and will, therefore, be trapped within the cell. Hydrophobic amines, including butylamine, spermidine, spermine, methylamine, and cyanine dyes (including those used for studying membrane potential or that are used as tracers in neurobiology) are examples of lysosomatropic agents. These lysosomatropic agents can be modified to be conjugated to a radioisotope or to a therapeutic compound (e.g. cytokines, SEB, SEA or other molecules) by a cleavable linkage to the radioisotope or compound. Other active sites on select amino acids can also serve as sites of attachment of drugs, dyes toxins or cytokines, such as OH groups on serine or threonine residues, the $CH_3S$ group on methionine residues, carboxyl groups (COOH) on aspartic or glutamic acid residues, amine groups on lysine residues or the N-terminus of the peptide construct or amide groups on asparagine. Such groups (e.g. OH, COOH, $CH_3S$ amine, amide, etc) can be engineered into the LEAPS™ heteroconjugates to serve as a conjugation site for the therapeutic compound or dye. In a similar manner, a radioisotope chelated by a chelation compound can be conjugated to the LEAPS™ heteroconjugates.

For the targeting of cancer, the ability of LEAPS™ heteroconjugate treated DCs to locate to the site of cancer cells can be utilized to deliver therapeutic agents directly to the site of the cancer cells. At least a portion of the LEAPS™ heteroconjugates used to treat the DCs is expected to remain associated with the DCs. As such, the LEAPS™ heteroconjugate can be associated or conjugated to a tracking marker, such as a radioisotope, or to a therapeutic or anti-cancer agent. For example, the LEAPS™ heteroconjugates peptide can be conjugated to a radioisotope chelated by a chelation compound can be conjugated to the LEAPS™ heteroconjugates.

An alternate approach for the association of a tracking marker or a therapeutic compound with the of LEAPS™ heteroconjugate treated DCs is conjugation of such species to the cell surface of the DCs. A tracking marker or therapeutic agent can be conjugated with a monoclonal antibody (mAb), a therapeutic agent or an anticancer agent. An organic molecule having the property of a therapeutic agent, an anticancer agent or a dye can be linked to a monoclonal antibody through a cysteine, lysine or other amino acid residue present on the mAb. A cleavable linker such as a valine-citrulline dipeptide linker can also be used. The mAb can have affinity for MHC II (anti-MHC II) or CD11c (anti-CD11c) or another cell surface marker present on DCs. Examples of cell surface markers for which the antibody can have affinity to include DEC-205, Dectin-1, DC-SIGN, and DC-LAMP. In this manner, the mAb servers to associate the therapeutic agent with the DCs with high affinity. Radioisotopes can be associated with DCs in a similar manner, where a radioisotope is either chelated by an organic chelation molecule or covalently bonded to an organic molecule conjugated with a mAb.

Examples of therapeutic compounds or anticancer agents include immune system suppressors or even cytotoxic drugs such as monomethyl auristatin E (MMAE), saporin, maytansinoid 1, ozogamicin, doxorubicin, emtansine, carboplatin, 5-fluorouracil, docetaxel, gelonin, receptor tyrosine kinase inhibitors, phosphatidylinositol 3-kinase inhibitors, norifensine, and irinotecan (CPT-11) as well as larger molecules such as interferon-alpha, staphylococcal enterotoxin A superantigen (SEA) or staphylococcal enterotoxin B (SEB) (using the chemical conjugating reagent N-succinimidyl 3-(2-pyridyldithio)propionate) or other agents such as 1-Ethyl-3(3-dimethylaminopropyl)carbodiimide (EDC) or 3-maleimidobenzoyl-N-hydroxysuccinimide ester (MBS) for some dyes or therapeutic agents) or other materials. Cytokines such as interferon-α can also be used as therapeutic agents. Additional therapeutic agents include methotrexate, 5-fluorouracil, azathioprine, mecaptopurine, cyclophosphamide, cyclosporine A and prednisone. The use of LEAPS™ heteroconjugate-treated DCs to deliver therapeutic agents can be particularly effective for addressing toxicity. For example, the antimitrotic agent auristatin is 100-1000 more potent than doxorubicin making auristatin highly toxic and not well-tolerated at therapeutic doses. By targeting such cytotoxic agents by conjugation with LEAPS™ heteroconjugate-treated DCs, the delivery of the cytotoxic agents to target cells is more specific and reduces safety concerns.

Further, radioisotopes can serve as therapeutic agents as well as tracking markers. Radioisotopes such as $^{90}$Y and $^{188}$Re are high-energy beta-emitters that can deliver ionizing radiation to the site of autoimmune related condition. Similarly, radioisotopes such as $^{64}$Cu and $^{124}$I are alpha-emitters that can be used to deliver ionizing radiation to the site.

In a further embodiment, the LEAPS™ heteroconjugate or a mAb can be conjugated to a fluorescent dye. Suitable dyes include N,N'-di-carboxypentyl-indodicarbocyamine-5, 5'-disulfonic acid (Cy 5.5) and other near-infrared (NIR) dyes such as those made by Alex fluor. Additional NIR probes include Cy 5.5 covalently linked to 4-N(S-glutathionylacetylaminophenyl)-arsenoxide-Cy5.5 and 2,3-dicyanonaphthalene-Cy5.5. Additionally, DCs can be directly stained by carboxyfluorescein succinimidyl ester (CFSE). Additional NIR probes include CSFE, Alexa Fluor® dyes (Alexa), or other NIR dyes covalently linked to 4-N(S-glutathionylacetylaminophenyl)arsenoxide or 2,3-dicyanonaphthalene, 4-N(S-glutathionylacetylaminophenyl)arsenoxide-CSFE, 4-N(S-glutathionylacetylaminophenyl)arsenoxide-Alexa, and 2,3-dicyanonaphthalene-CSFE, and 2,3-dicyanonaphthalene-Alexa. In particular, CY 5.5 Alexa Fluor® and other NIR dyes exhibit low absorption of the NIR signal in tissue at operating wavelengths and may be quenched by conjugation of two or more NIR probe molecules together. Cleavage of the conjugation bonds results in fluorescence dequenching and generation of a signal that is suitable for imaging. A fluorescent image can be made by endoscopy or by taking a tissue biopsy. A tissue biopsy can be examined by flow cytometry to identify the presence of fluorescent cells.

EXAMPLES

The ability of a LEAPS™ heteroconjugate containing an antigen originating from herpes simplex I virus (HSV-I) was investigated to demonstrate the ability of LEAPS™ heteroconjugate to cause the maturation of treated DCs. The JgD LEAPS™ heteroconjugate peptide contained peptide J (DLLKNGERIEKVE, SEQ ID No. 49) conjugated to a peptide from the N-terminus of HSV-I glycoprotein D (gD) (SLKMADPNRFRGKDLP, SEQ ID No. 952), amino acid 8-23, through a triglycine linker. As such, the JgD LEAPS™ heteroconjugate peptide has the sequence DLLKNGERIEKVEGGGSLKMADPNRFRGKDLP (SEQ ID No. 953).

An additional LEAPS™ heteroconjugate containing an antigen derived from HIV virus was also used to demonstrate the ability of LEAPS™ heteroconjugate to cause a maturation of DCs. The JH LEAPS™ heteroconjugate peptide vaccine contained the peptide J (SEQ ID No. 49) ICBL conjugated to a peptide "HGP-30 (H) peptide from the p17 HIV gag protein YSVHQRIDVKDTKEALEKIEEEQNKSKKKA (aa 85-115) (SEQ ID No. 954) through a triglycine linker. As such, the JgH LEAPS™ heteroconjugate peptide has the sequence DLLKNGERIEKVEGGGYSVHQRIDVKDTKEALEKIEEEQNKSKKKA (SEQ ID No. 955).

Preparation of Bone Marrow Cells

Bone marrow (BM) cells were prepared. Briefly, the femurs and tibias were obtained from five C57BL/6 female mice, and the ends were removed to expose the hollow bone packed with marrow. BM cells were flushed from the bones with cold Hanks Balanced Salt Solution (HBSS) using a sterile disposable 22 g needle and pooled. Red blood cells (RBCs) were lysed using Tris-buffered ammonium chloride and resultant cells were washed 3 times in HBSS, BM cells were suspended in tissue culture medium (TCM) (RPMI 1640 with glutaminic plus 100 mg/nL PenStrep, 50 µM 2-mercaptoethanol, and 5% fetal calf serum) at approximately 5×10⁶ cells/ml and incubated for 1 hour at 37° C. in a 5% CO2 atmosphere in plastic tissue culture flasks to remove adherent, mature macrophages. Decanted non-adherent cells were resuspended in TCM and $1.5\times10^6$ BM cells in 1 ml were placed into each well of a 24 well tissue culture plate (Falcon) and either left untreated or treated with 14.5 micromoles of peptide J or JgD LEAPS™ heteroconjugate. After incubation for 48 hrs at 37° C., cells were viewed and photographed for changes in morphology, tissue culture supernatants were removed and the cells were prepared for flow cytometric analysis.

Immature DCs were generated from the bone marrow of five normal C57BL/6 female mice. Briefly, BM cells were harvested as before and cultured at $5\times10^5$/ml in 75 cm2 flasks at 37° C., 10% CO2 for 6 days in a complete media (CM) containing RPMI 1640, 10% fetal bovine serum, 2 mM glutamine, 0.1 mM nonessential amino acids, 100 units/ml sodium pyruvate, 100 mg/ml PenStrep, 0.5 mg/ml fungizone, 50 ug/ml gentamicin, 50 um 2-mercaptoethanol, supplemented with 10 ng/ml of human IL-6 (Peptrotech, Rocky Hill, N.J.) and 10 ng/ml human Flt-3 (gift of Amgen, Thousand Oaks, Calif.). On day 6, the cells were washed twice in Dulbecco's PBS. $4\times10^6$ cells/well were transferred to a 24-well cluster plate and cultured in CM supplemented with 10 ng/ml of human GM-CSF (gift of Immunex, Seattle, Wash.), and incubated for 24 hrs. Cells were then analyzed by flow cytometry for expression of CD11c, CD80, CD86, MHC II, CD34, and OX40L, confirming the purity or the iDC population.

Immature DCs were either untreated or treated with 3.625, 7.25, or 14.5 micromoles of JgD peptide and maintained in CM without GM-CSF. After 48 h incubation, spent medium was removed and immediately tested for the presence of IL-12p70 by direct ELISA.

Flow Cytometry Analysis

For analysis of CD11c and CD86 expression, untreated and peptide treated BM cells, prepared and treated as described above, were labeled with PE-anti-Cd11c or PE-anti CD86 (Beckman Coulter Fullerton, Calif.) At least 106 cells were analyzed (Altra FACS, Beckman Coulter) using forward and side scatter parameters to limit (gating) the immunofluorescence analysis to cells of the size and granularity of monocytes and dendritic cells.

CD3+ cells were removed from BM cells using the fluorescence activated cell sorter and then untreated or treated with JgD, gD or JH. Flow cytometric analysis of the sorted population confirmed the removal of CD3 positive cells. The CD3− BM cells were labeled with FIT C-anti-CD8 (Beckman Coulter (clone 53-6.7)), fixed with paraformaldehyde, permeabilized with saponin (Intraprep, Immunotech), labeled with PE-anti-IL-12p70 (Beckman Coulter) and then post fixed with paraformaldehyde prior to immunofluorescence analysis.

The monocyte population of BM cells, as defined by light scatter parameters, was analyzed on the second day after treatment with J, gD, JgD or JH. Representative flow cytometric results are presented in FIGS. 1A-1B.

The untreated monocyte population contained very few CD11c or CD86 positive cells whereas the JgD LEAPS™ heteroconjugate-treated cells expressed CD11c (FIG. 1A) and CD86 (FIG. 1B). CD11c is a type I transmembrane protein found on most human and mouse dendritic cells and CD86 is a cell marker for mature DCs capable of signaling and activating T cells.

Treatment with gD or the J-ICBL alone caused no discernible change in CD11c or CD86 expression. Similarly, there was no significant increase in IL-12p70 expressing cells following J-ICBL treatment.

Herpes Simplex Virus Challenge in the Zosteriform Spread Mouse Model

Mouse bone marrow cells were treated with JgD LEAPS™ heteroconjugate and incubated for 24 h, washed free of unbound vaccine or media components, and then injected subcutaneously or intraperitoneally. The subcutaneously or intraperitoneally injected cells conferred protection from disease and death from lethal herpes simplex virus challenge in the zosteriform spread mouse model. Mice (C57BL/6) received two injections of either JgD LEAPS™ heteroconjugate-treated DCs or untreated bone marrow cells. JgD LEAPS™ heteroconjugate-treated DCs were prepared by treating bone marrow cells with JgD for 24 h and the cells were washed free of peptide and media components. JgD LEAPS™ heteroconjugate-treated DCs or bone marrow cells were injected intradermally and intraperitoneally with a two week window and then the mice received a lethal challenge with HSV-I H129 in the zosteriform-challenge model. Mice were either untreated, treated with 24 h cell cultured bone marrow cells (BM). J Peptide ICBL treated bone marrow cells (J-BM), JH LEAPS™ heteroconjugate-treated dendritic cells (JH-DC) or JgD LEAPS™ heteroconjugate-treated bone marrow cells (JgD-DC). Symptoms were scored on the following scale: 0: no disease; 1: non-specific changes: 2: local disease; 3: early zosteriform spread; 4: later zosteriform spread with scores; 5: moribund disease; 6: death. Mice were scored daily for symptoms and the average for the group is presented in FIG. 3.

Mice receiving no treatment, untreated mouse bone marrow cells (BM), mouse bone marrow cells treated with the J peptide immune cell binding ligand only (J-BM) and/or JH LEAPS™ heteroconjugate-treated dendritic cells (JH-DC) incurred significant disease with zosteriform spread and death of a majority of the group within 2 weeks. Whereas, all of the mice receiving bone marrow cells treated with JgD LEAPS™ heteroconjugate-treated dendritic cells (JgD-DC) and challenged with HSV-survived and most showed signs of disease (6 of 7).

Figure 2:
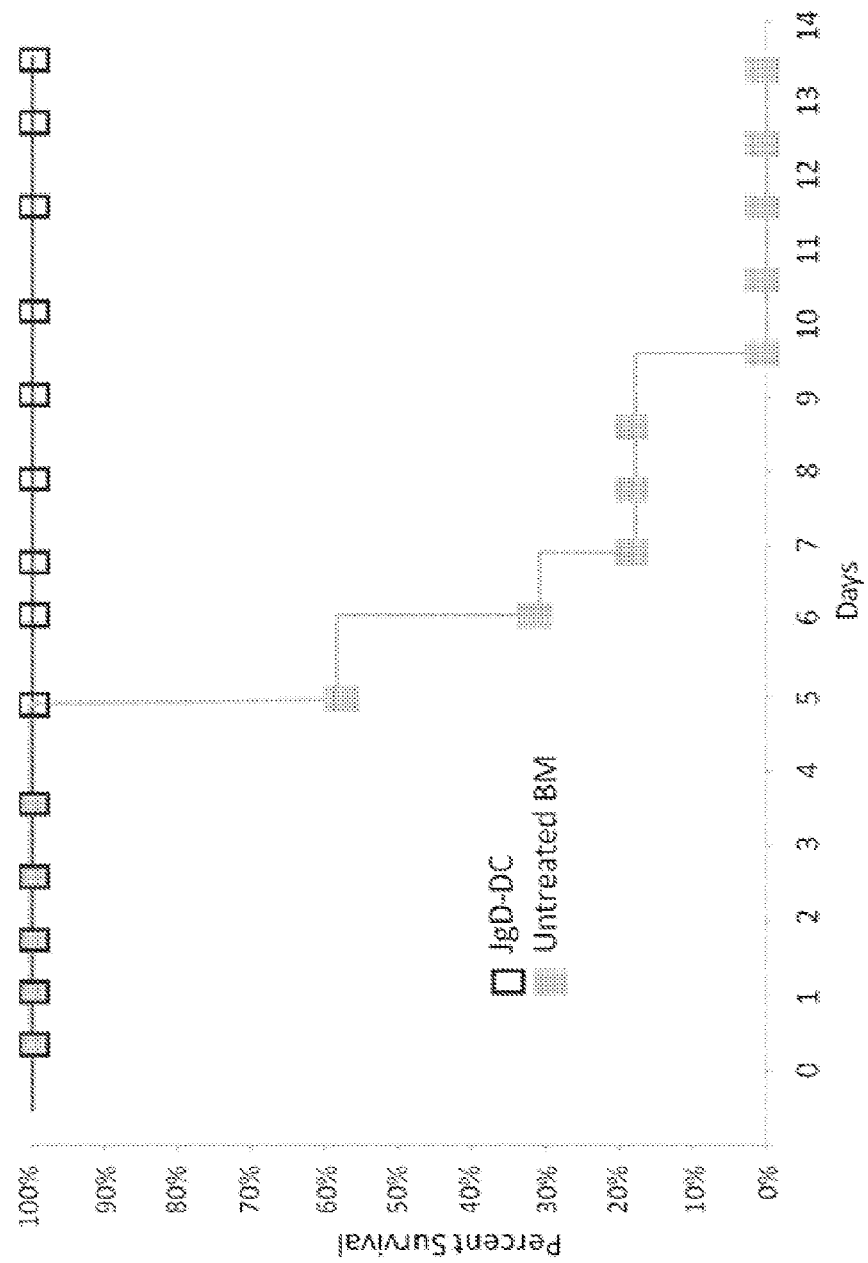
FIG. 2 shows Kaplan-Meier survival curve for mice vaccinated with either the JgD LEAPS® heteroconjugate-treated DC or untreated BM receiving lethal challenge with herpes simplex virus type 1 by zosteriform challenge.
Figure 3:
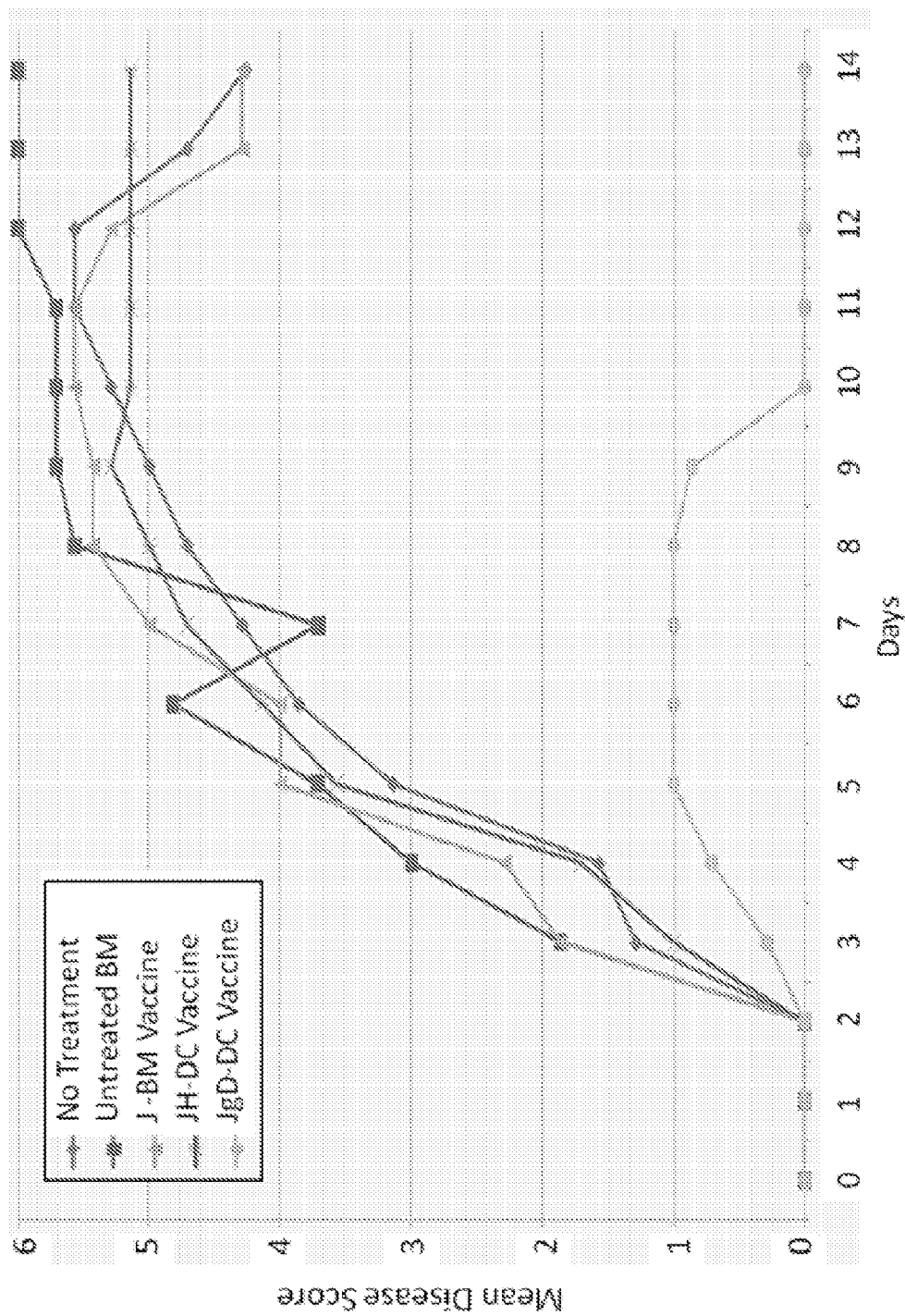
FIG. 3 shows reduction in symptoms of mice (see FIG. 2) treated with JgD LEAPS™ heteroconjugate-treated DC as compared with: No treatment; Untreated BM; J-H; or JH LEAPS™ heteroconjugate-treated DC.

FIG. 2 shows a Kaplan Meier survival curve for the JgD-DC and untreated BM vaccinated mice. FIG. 3 is a disease score plot showing a reduction or prevention of symptoms of disease signs for mice treated with JgD-DC as compared with: No treatment; Untreated BM; j BM; and JH-DC.

These results prove that the DCs generated by JgD treatment of bone marrow cells are sufficient to initiate and develop an immune response sufficient to provide protection from a large lethal HSV infection. These results further prove that the LEAPS peptide stays on the surface of the DC for long periods and can interact with T cells to elicit the response.

Immune Modulation in an Arthritis Model

The ability of LEAPS™ heteroconjugates to modulate an immune response in an autoimmune condition was investigated for heteroconjugates labeled CEL-2000 (DLLKNGE-RIEKVEGGGTGGKPGIAGFKGEQGPKGEP, SEQ ID No. 912) and CEL-2003 (DLLKNGERIEKVEGGGD-AGEPGIAGFKGDQGPKGET, SEQ ID No. 956). CEL-2000 is formed by linking Peptide J (SEQ ID No. 49) to the human type II collagen peptide 254-273 (TGGKPGIAGFK-GEQGPKGEP, SEQ ID No. 812) through a triglycine linker. CEL-2003 is formed by linking Peptide J (SEQ ID No. 49) to the corresponding murine type II collagen peptide 254-273, DAGEPGIAGFKGDQGPKGET (SEQ ID No. 855), through a triglycine linker.

The following study is of CEL-2000 therapeutic vaccine for collagen induced arthritis (CIA) where the first step was to identify a good animal model for testing the vaccine, which is the collagen induced arthritis (CIA) model in young (6-7) week old male DBA/IJ mice. These mice received 2 injections of bovine collagen the first in complete Freund's adjuvant (CFA) on day 0 and then 3 weeks later on day 21, in Incomplete CFA. After the second collagen injection, the mice were evaluated daily for any joint swelling or redness. Each of the paws was scored on a 4 point scale (Arthritis Index (AI) with respect to the number of digits with symptoms and the thickness of the paw measured, at least 3-4 times a week. Each mouse was weighed weekly.

Figure 4:
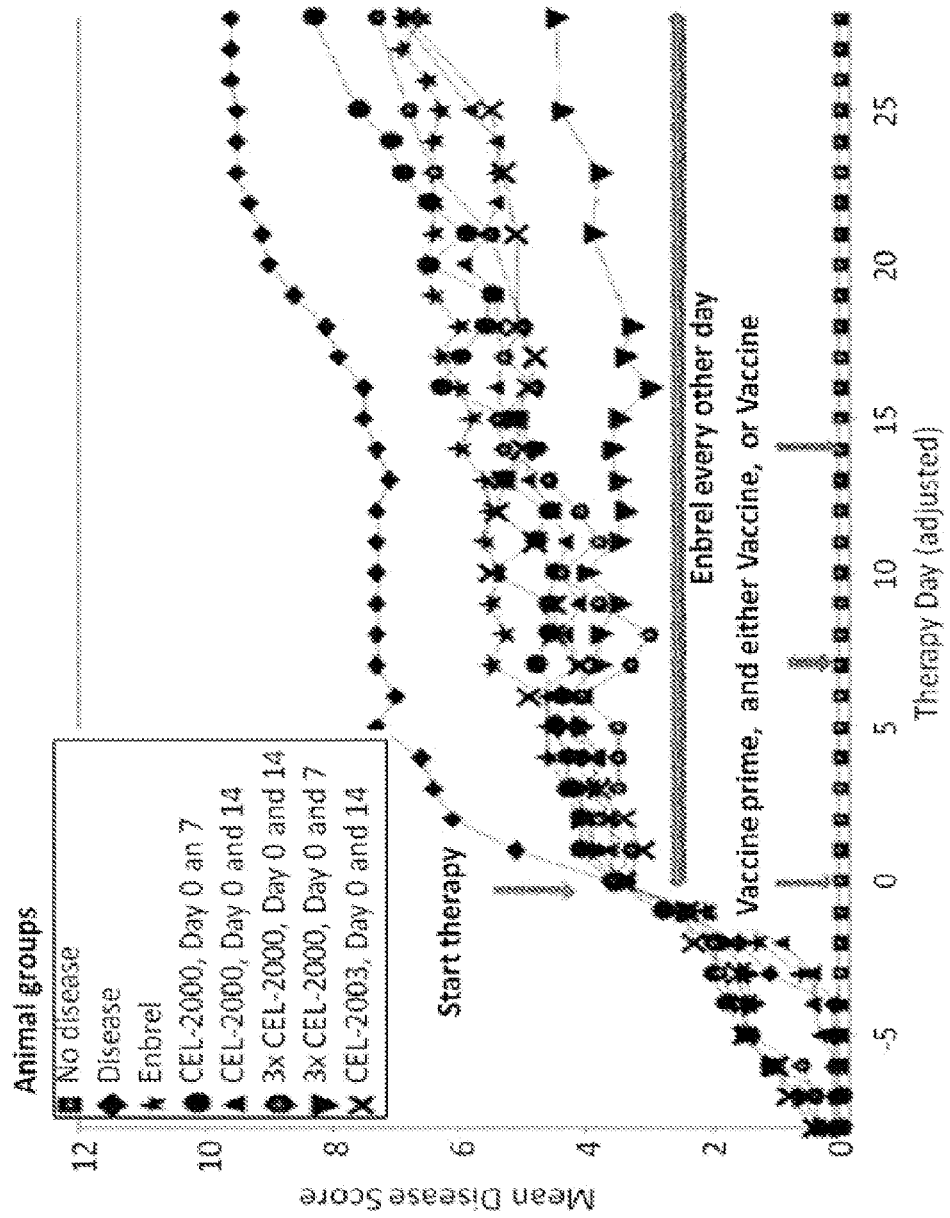
FIG. 4 represent a study where CEL-2000 treatment with 2 doses of 33 or 100 nmol was given subcutaneously on days 0 and 7 or days 0 and 14. Most regimes reduced the progression of arthritis disease to levels that were at least as good as those of mice treated with Enbrel® (every other day for the 28 days of the study). Immunization of mice with the 100 nmol dose (3× treatment) on days 0 and 7 appeared to limit the progression of disease throughout the experimental period. The CEL-2003 links the murine collagen II peptide, residues 254-273 ($CH_{254-273}$), sequence to the J ICBL. This trial suggests that the dosage and schedule of administration (time between initial and second immunization) are important parameters of CEL-2000 treatment. Use of a student "t" Test analysis of Treatment groups at day 7 days 14 and 21 to calculate the p value showed the 3× dose of CEL-2000 on day 0 and 14 followed by 3× dose on day 0 and 7 or 1× dose on day 0 and 7 is equivalent to 0 and 14 and slightly better than Enbrel® every other day for all 28 days.

When significant disease is noted, usually about day 28, the mice are grouped (n=8) with a range of scores between 1 and 6 and group mean of 2.5 to 3. At this point the therapy begins according to protocol. Controls include groups with induced disease but no therapy and groups of healthy mice without induced disease. A therapy control of Enbrel® (3 mg/kg, every other day) was included. Over the 28-day course of study, the outcomes of different CEL-2000 and CEL-2003 treatment schedules were compared with Enbrel. In this study, CEL-200 treatment with 2 doses of 33 or 100 nmol were given subcutaneously on days 0 and 7 or on days 0 and 14. CEL-2003 was used at one dose of 33 mmol on days 0 and 14. Most regimes reduced the progression of arthritis disease to levels that were at least as good as those of mice treated with Enbrel® (every other day for the 28 days of the study). Immunization of mice with the 100 nmol dose (3× treatment) on days 0 and 7 appeared to limit the progression of disease throughout the experimental period as shown in FIG. 4. The AI score for each paw (4 paws total) were added for each group and reported on FIG. 4.

The CEL-2003 links the corresponding murine (CII254-273 sequence DAGEPGIAGFKGDQGPKGET (SEQ ID No. 855) to the J ICBL. This trial suggests that the dosage and schedule of administration (time between initial and second immunization) are important parameters for CEL-2000 treatment. Use of a student "t" Test analysis of Treatment groups at day 7 days 14 and 21 to calculate the p value showed the 3× dose of CEL-2000 on day 0 and 14 followed by 3× on day 0 and 7 or 1× on day 0 and 7 is equivalent to days 0 and 14 and slightly better than Embrel every other day for all 28 days.

As such LEAPS™ heteroconjugates are demonstrated to be at least as affective as Enbrel® in addressing the autoimmune response in the CIA model. As such, LEAPS™ heteroconjugates are demonstrated immunomodulators.

REFERENCES

1 Hammer et al., HLA class I peptide binding specificity and autoimmunity, 1997, Adv. Immunol, 66:67 Tisch et al., Induction of Glutamic Acid Decarboxylase 65-Specific Th2 Cells and Suppression of Autoimmune Diabetes at Late Stages of Disease Is Epitope Dependent 1999. J. Immunol. 163:1178; Yoon et al., Control of Autoimmune Diabetes in NOD Mice by GAD Expression or Suppression in β Cells 1999, Science 284:1183; Ruiz et al., Suppressive Immunization with DNA Encoding a Self-Peptide Prevents Autoimmune Disease: Modulation of T Cell Costimulation 1999, J. Immunol., 162:3336: Kreo et al., Identification of T Cell Determinants on Human Type II Collagen Recognized by HLA-DQ8 and HLA-DQ6T Transgenic Mice 1999, J. Immunol., 163-1661.
2 Gharavi et al., GDKV-Induced Antiphospholipid Antibodies Enhance Thrombosis and Activate Endothelial Cells In Vivo and In Vitro 1999, J. Immunol., 163:2922
3 U.S. Pat. No. 4,666,829.
4 WO9748792A1, WO 98/03644A1 and U.S. Pat. No. 5,811,633 (Frenkel et al., 2001 Generation of autoantibodies towards Alzheimer's disease vaccination. Vaccine 19:2615.
5 Li et al., Cryptic Epitope Identified in Rat and Human Cardiac Myosin S2 R Induces Myocarditis in the Lewis Rat. J Immunol, 2004, 172:3225-3234), and include S2-16
6 Autoantibodies against cardiac troponin 1 are responsible for dilated cardiomyopathy in PD-1-deficient mice, Nat Med. 2003 December: 9(12):1477-83.
7 Ansari et al (1994 "Epitope mapping of the branched chain alpha-ketoacid dehydrogenase dihydrolipoyl transacylase (BCKD-E2) protein that reacts with sera from patients with idiopathic dilated cardiomyopathy". J Immunol 153(10):4754-65) identified the peptide BCKD-E2$_{116\text{-}134}$.
8 Adderson E et al (1998, Molecular analysis of polyreactive monoclonal antibodies from rheumatic carditis: human anti-N-acetylglucosamine/anti-myosin antibody V. region genes, J. Immunol. 161:2020-31) identified two peptides as follows LMM 1
9 Wilson et al., Therapeutic alteration of Insulin-Dependent Diabetes Mellitus. Progression by T Cell Tolerance to Glutamic Acid Decarboxylase 65 Peptides In Vitro and In Vivo, 2001, J Immunol., 167:569, Tisch et al., SUPRA 1999 J I 163:1178; Karlsson et al., Th1-like dominance in high-risk first-degree relatives of type I diabetic patients 2000. Diabetologia 43:742.
10 (Quinn et al., MHC Class I-Restricted Determinants on the Glutamic Acid Decarboxylase 65 Molecule Induce Spontaneous CTL Activity, 2001, J. Immunol., 167: 1748, Herman A et al., Determination of Glutamic Acid Decarboxylase 65 Peptides Presented by the Type 1 Diabetes-Associated HLA-DQ8 Class II Molecule Identifies an Immunogenic Peptide Motif 1999 JI 163: 6275; Winer at al., Peptide Dose, MHC affinity, and Target Self-Antigen Expression Are Critical for Effective Immunotherapy of Nonobese Diabetic Mouse Prediabetes 2000 JI 165:4086.
11 Wilson et al., SUPRA Karlsson et al., SUPRA.
12 Quinn et al., SUPRA JI 167:1748 2001, Herman A et al., SUPRA 1999 JI 163:6275, Liu J, et al., Major DQ8-restricted T-cell epitopes for human GAD65 mapped using human CD4, DQA1*0301, DQB1*0302 transgenic IA (null) NOD mice Diabetes, 1999 March; 48(3):469-77.
13 Winer et al., SUPRA 2000 JI 165:4086, Karlsson et al., SUPRA Diabetologia 43:742.
14 Urbank-Ruiz et al., Immunization with DNA encoding an immunodominant peptide of insulin prevents diabetes in NOD mice, 2001, Clin Immunol 100(2): 164-171, Abiru et al., Peptide and Major Histocompatibility Complex-Specific Breaking of Humoral Tolerance to Native Insulin With the B9-23 Peptide in Diabetes-Prone and Normal Mice Diabetes 50:1274 2001.
15 Elias et al., Induction of diabetes in standard mice by immunization with the p277 peptide of a 60-kDa heat shock protein, 1995, Eur J Immunol 25:2815.
16 Ou et al., Cross-reactive rubella virus and glutamic acid-decarboxylase (65 and 67) protein determinants recognized by T cells of patients with type 1 diabetes mellitus, 2000, Diabetologia 43:750.
17 Peakman M 1999: (Naturally processed and presented epitopes of the islet cell autoantigen IA-2 eluted from HLA-DR4, J. Clin Invest 104:1449-1457).

18 Krco C et al (1999 Identification of T cell determinants on human type II collagen recognized by HLA-DQ8 and HLA-DQ6 transgenic mice. J Immunol. 163(3): 1661-5
19 Yamamoto N et al (2003 Essential role of the cryptic epitope SLAYGLR within osteopontin in a murine model of rheumatoid arthritis. J. Clin. Invest. 112:181-188.
20 Prakken B et al 2004 Epitope-specific immunotherapy induces immune deviation of proinflammatory T cells in rheumatoid arthritis, Proc Nat Acad Sci USA 101: 4228-4233.
21 Veldman C et al (2004 T cell recognition of desmoglein 3 peptides in patients with pemphigus vulgaris and healthy individuals. J Immunol. 172:3883-92).
22 Abreu-Velez A et al (2003 The tryptic cleavage product of the mature form of the bovine desmoglein 1 ectodomain is one of the antigen moieties immunoprecipitated by all sera from symptomatic patients affected by a new variant of endemic pemphigus. Eur J Dermatol. 13:359-66.
23 Hammer J, et al (1997 HLA class II peptide binding specificity and autoimmunity. Adv. Immunol. 66:67-100).
24 Ruiz P, et al. (1999 Suppressive immunization with DNA encoding a self-peptide prevents autoimmune disease: modulation of T cell costimulation. J Immunol. 162:3336-41).
25 Araga S et al (1999) A complementary peptide vaccine that induces T cell anergy and prevents experimental allergic neuritis in Lewis rats. J. Immunol. 163(1):476-82.). In a related mocel Experimental Allergic neuritis a peptide from peripheral nerve P2 60-70 or EAN 60-70.
26 de Rosbo N et al (2004). The myelin-associated oligodendrocytic basic protein region MOBP15-36 encompasses the immunodominant major encephalitogenic epitope(s) for SJL/J mice and predicted epitope(s) for multiple sclerosis-associated HLA-DRB1*1501. J Immunol. 173:1426-35; Khare M et al (2003). HLA class II transgenic mice authenticate restriction of myelin oligodendrocyte glycoprotein-specific immune response implicated in multiple sclerosis pathogenesis. Int Immunol. 15:535-46.
27 Krogsgaard M et al (2000: visualization of Myelin Basic Protein (MBP) T Cell Epitopes in Multiple Sclerosis Lesions using a Monoclonal Antibody Specific for the Human Histocomatibility Leukocyte Antigen (HLA)-DR2-MBP 85-99 Complex, J. Exp Med. 191:1395-1412.
28 Pender M et al (2000 Surges of Increased T Cell Reactivity to an Encephalitogenic Region of Myelin Proteolipid Protein Occur More Often in Patients with Multiple Sclerosis Than in Healthy Subjects, J. Immunol. 165:5322-5331.
29 Forsthuber T. et al (2001 T Cell Epitopes of Human Myelin Oligodendrocyte Glycoprotein Identified in HLA-DR4 (DRB1*0401) Transgenic Mice Are Encephalitogenic and Are Presented by Human B Cells, J Immunol 167:7119-7125.
30 Fridkis-Hareli M, et al (2002: Novel synthetic amino acid copolymers that inhibit autoantigen-specific T cell responses and suppress experimental autoimmune encephalomyelitis, J Clin Invest 109:1635-1643.
31 Weissert R, et al (2002: High Immunogenicity of Intracellular Myelin Oligodendrocyte Glycoprotein Epitopes, J Immunol, 169:548-556.
32 Bora N et al 1997 Induction of experimental autoimmune anterior uveitis by a self-antigen: melanin complex without adjuvant. Invest Ophthalmol vis Sci. 1997 September: 38(10):2171-5; bora N et al 1995 Experimental autoimmune anterior uveitis. Induction with melanin-associated antigen from the iris and ciliary body. Invest Ophthalmol Vis Sci. May: 36(6):1056-66); Mirahi T et al (2002 The Tissue-Specific Self-Pathogen Is the Protective Self-Antigen: The Case of Uveitis; J Immunol: 169:5971-5977) 1177-1191.
33 Avichezer D et al (2000 Identification of a New Epitope of Human IRBP that Induces Autoimmune Uveoretinitis in Mice of the H-2b Haplotype; Invest Ophthalmol Vis Sci., 2000, 41:127-131.
34 Yoshikawa H et al 1997 A 17-Mer self-peptide of acetycholine receptor binds to B cell MHC class II, activates helper T cells, and stimulates autoantibody production and electrophysiologic signs of myasthenia gravis. J Immunol. 159:1570-7).
35 Ben-Davis H et al 2005 Down-regulation of myasthenogenic T cell responses by a dual altered peptide ligand via CD4+CD25+-regulated events leading to apoptosis, PNAS; 2028-2033).
36 Iversen et al arch Dermatol Res 287:761 1995.
37 Autoimmune Diseases and peptide Variations. Wataru Honda, et al. Genome Informatics 2005, 16(1): 272-280.
  37.17 hsa23439
  37.33 hsa1579
  37.10 has 1059
  37.7 hsa55703
  37.7.1 hsa 3008
  37.7.2 hsa 54433
  37.20 hsa4650
  37.13 has 9967
  37.15 has 7155
  37.18 has 1288
  37.12 has 27253

Items 38-74 shown by the following accession numbers are available from "The NCBI handbook [Internet]. Bethesda (Md.): National Library of Medicine (US), National Center for Biotechnology Information; 2002 October Chapter 18. The Reference Sequence (RefSeq) Project. Available from www.ncbi.nlm.nih.gov."

38 Protein Sequence Identification Number GI: 324021738
39 Protein Sequence Identification Number GI: 324021740
40 Protein Sequence Identification Number GI: 119586557
41 Protein Sequence Identification Number GI: 151101270
42 Protein Sequence Identification Number GI: 219517967
43 Protein Sequence Identification Number GI: 55662652
44 Protein Sequence Identification Number GI: 189405
45 Protein Sequence Identification Number GI: 331640463
46 Protein Sequence Identification Number GI: 94538350
47 Protein Sequence Identification Number GI: 109730054
48 Protein Sequence Identification Number GI: 119964718
49 Protein Sequence Identification Number GI: 1162922
50 Protein Sequence Identification Number GI: 187417
51 Protein Sequence Identification Number GI: 4505909

52 Protein Sequence Identification Number GI: 168985765
53 Protein Sequence Identification Number GI: 4506453
54 Protein Sequence Identification Number GI: 300253216
55 Protein Sequence Identification Number GI: 4261947
56 Protein Sequence Identification Number GI: 219519980
57 Protein Sequence Identification Number GI: 62952506
58 Protein Sequence Identification Number GI: 238908505
59 Protein Sequence Identification Number GI: 4885379
60 Protein Sequence Identification Number GI: 9506713
61 Protein Sequence Identification Number GI: 194272142
62 Protein Sequence Identification Number GI: 284172514
63 Protein Sequence Identification Number GI: 116283446
64 Protein Sequence Identification Number GI: 19913408
65 Protein Sequence Identification Number GI: 219521281
66 Protein Sequence Identification Number GI: 324021738
67 Protein Sequence Identification Number GI: 110671329
68 Protein Sequence Identification Number GI: 154425704
69 Protein Sequence Identification Number GI: 4557671
70 Protein Sequence Identification Number GI: 119590557
71 Protein Sequence Identification Number GI: 62094
72 Protein Sequence Identification Number GI: 119578370
73 Protein Sequence Identification Number GI: 331640463
74 Protein Sequence Identification Number GI: 1246092
75 Lemere C A, Maron R, Spooner E T, Grenfell T J, Mori C, Desai R, Hancock W W, Weiner H L, Selkoe D J. Nasal A beta treatment induces anti-A beta antibody production and decreases cerebral amyloid burden in PD-APP mice. Annals of the New York Academy of Sciences 2000 January; 920:328-31.
76 Lee M. Bard F, Johnson-Wood K, Lee C, Hu K, Griffith S G. Black R S, Schenk D, Seubert P. Abeta42 immunization in Alzheimer's disease generates Abeta N-terminal antibodies. Annals of neurology 2005 September: 58(3):430-5.
77 Fu H J, Liu B, Frost J L, Lemere C A. Amyloid-beta immunotherapy for Alzheimer's disease. CNS & neurological disorders drug targets 2010 April: 9(2):197-206.
78 Monsonego A. Maron R, Zota V, Selkoe D J. Weiner H L. Immune hyporesponsiveness to amyloid beta-peptide in amyloid precursor protein transgenic mice: implications for the pathogenesis and treatment of Alzheimer's disease. Proceedings of the National Academy of Sciences of the United States of America 2001 August: 98(18):10273-8.
79 Monsonego A, Zota V, Karni A, Krieger J I, Bar-Or A, Bitan G, Budson A E, Sperling R, Selkoe D J, Weiner H L. Increased T cell reactivity to amyloid beta protein in older humans and patients with Alzheimer disease. The Journal of clinical investigation 2003 August: 112(3):415-22.

80 Dobritzsch D et al 2011 Crystal structure of an arthritogenic anticollagen immune complex. Art & Rheum: 63:3740-3748.
81 Protein Sequence Identification Number GI: 111118976.
82 Benlalam, H. et al. (2003) Identification of five new HLA-B*3501-restricted epitope derived from common melanoma-associated antigens, spontaneously recognized by tumor-infiltrating lymphocytes. J. Immunol, 171:6283-9.
83 Butterfield L H, et al. (1999) Generation of human T-cell responses to an HLAA2.1-restricted peptide epitope derived from alpha-fetoprotein. Cancer Res. 59:3134.
84 Domenech N, et al. (1995) Identification of an HLA-A11-restricted epitope from the tandem repeat domain of the epithelial tumor antigen mucin. J. Immunol. 155:4766-74.
85 Fisk B, et al. (1995) Identification of an immunodominant peptide of HER-2/neuprotooncogene recognized by ovarian tumor-specific cytotoxic T lymphocyte lines. J Exp Med. 181:2109.
86 Gaugler B, et al. (1994) Human gene MAGE-3 codes for an antigen recognized on a melanoma by autologous cytolytic T lymphocytes. J. Exp. Med. 179:921-30.
87 Germain J P F, et al. (1995) T-helper epitopes of the E7 transforming protein of cervical cancer associated human papillomavirus type 18 (HPV18). Virus Research 36:1-13.
88 Gritzapis A D, et al. (2005) Pooled peptides from HER-2/neu-overexpressing primary ovarian tumours induce CTL with potent antitumour responses in vitro and in vivo. Br. J. Cancer, 92:72-9.
89 Kono K, et al. (1998) Identification of HER2/neu-derived peptide epitopes recognized by gastric cancer-specific cytotoxic T lymphocytes. Int. J. Cancer 78:202
90 Liu K J, et al. (2004) Generation of carcinoembryonic antigen (CEA)-specific T-cell responses in HLA-A-A*0201 and HLA-A*2402 late-stage colorectal cancer patients after vaccination with dendritic cells loaded with CEA peptides. Clin. Cancer Res. 10:2645-51.
91 Mincheff M, et al. (2005) Depletion of CD25+ cells from human T-cell enriched fraction eliminates immunodominance during priming with dendritic cells genetically modified to express a secreted protein. Cancer Gene Ther. 12:185-97.
92 Parkhurst M R, et al. (1998) Identification of a shared HLA-A*0201-restricted T-cell epitope from the melanoma antigen tyrosinase-related protein 2. Cancer Res. 58:4895-901.
93 Siegel S, et al. (2006) Identification of HLA-A*0201-presented T cell epitopes derived from the oncofetal antigen-immature laminin receptor protein in patients with hematological malignancies. J. Immunol. 176: 6935-44.
94 Tanzarella S, et al. (1999) Identification of a promiscuous T-Cell epitope encoded by multiple members of the MAGE family. Cancer Res. 59:2668-74.
95 Tatsumi T, et al. (2003) MAGE-6 encodes HLA-DRB1*401-presented epitopes recognized by CD4+ T cells from patients with melanoma or renal cell carcinoma. Clin. Cancer Res. 9:947-54.

Items 96-107 shown by the following accession numbers are available from "The NCBI handbook [Internet]. Bethesda (Md.): National Library of Medicine (US), National Center for Biotechnology Information: 2002 October Chapter 18, The Reference Sequence (RefSeq) Project. Available from www.ncbi.nlm.nih.gov."

96 Accession Number: NP_001125.1
97 Accession Number: NP_004354.2
98 Accession Number: AAA75493.1
99 Accession Number: ADH94043.1
100 Accession Number: P08865
101 Accession Number: NP_786885.1
102 Accession Number: NP_005353.1
103 Accession Number: NP_001090.2
104 Accession Number: NP_001639.1
105 Accession Number: NP_002447.4
106 Accession Number: NP_002448.2
107 Accession Number: NP_001913.2
108 Wang R F, et al. (1996) Utilization of an alternative open reading frame of a normal gene in generating a novel human cancer antigen. *J. Exp. Med.* 183:1131-40.
109 Scardion A, Alves P et al. 2001. Identification of HER-2/neu immunogenic epitopes presented by renal cell carcinoma and other human epithelial tumors. Eur J Immunol 31: 3261-3270.
110 Jing Li, et al. A Bioinformatics Workflow for Variant Peptide Detection in Shotgun. *Proteomics*. (in Press, Published Mar. 9, 2011 as Manuscript M110.006536).
111 Atsuhiko Toyama, et al Deglycosylation and label-free quantitative LC-MALDI MS applied to efficient serum biomarker discovery of lung cancer. Proteome Science 2011, 9:18.
112 Wei-Chao Change et al Observation of Peptide differences between cancer and control in gastric juice. Proteomics Clinical Application 2008: 2, 55-62.
113 Chaunya Sun et al. Periostin identified as a potential biomarker of prostate cancer by iTRAQ-proteomics analysis of prostate biopsy. Proteome Sciences 2011, 9:22.
114 Chan, P. K. S. et al. T-cell Response to Human Papilomavirus Type 52 L1, E6 and E7 Peptides in women with Transient Infection. Cervical Intraepithelial Neoplasma, and Invasive Cancer. Journal of Medical Virology 2011, 83:1023-1030.

Items 115-134 shown by the following accession numbers are available from "The NCBI handbook [Internet] Bethesda (Md.): National Library of Medicine (US). National Center for Biotechnology Information: 2002 October Chapter 18. The Reference Sequence (RefSeq) Project. Available from www.ncbi.nlm.nih.gov."

115 Protein Sequence Identification Number GI:5533332
116 Protein Sequence Identification Number GI:306840
117 Protein Sequence Identification Number GI:119370332
118 Protein Sequence Identification Number GI:156187070
119 Protein Sequence Identification Number GI:397038
120 Protein Sequence Identification Number GI:327200633
121 Protein Sequence Identification Number GI:223869081
122 Protein Sequence Identification Number GI:119592329
123 Protein Sequence Identification Number GI:119599607
124 Protein Sequence Identification Number GI:282160147
125 Protein Sequence Identification Number GI:62898243
126 Protein Sequence Identification Number GI:194388772
127 Protein Sequence Identification Number GI:270346336
128 Protein Sequence Identification Number GI:180211
129 Protein Sequence Identification Number GI:119576392
130 Protein Sequence Identification Number GI:221043556
131 Protein Sequence Identification Number GI:119615441
132 Protein Sequence Identification Number GI:194391112
133 Protein Sequence Identification Number GI:226192647
134 Protein Sequence Identification Number GI:4503119

SEQUENCE LISTING (1093 sequences)

SEQ ID NO: 1 - protein, 13 aa, Homo sapiens
IAGFKGEQGPKGE

SEQ ID NO: 2 - protein, 8 aa, Homo sapiens
KNIVTPRT

SEQ ID NO: 3 - protein, 15 aa, Homo sapiens
GDKVSFFCKNKEKKC

SEQ ID NO: 4 - protein, 17 aa, Artificial Sequence
  peptide construct
VLWKKQKDKVAELENSE

SEQ ID NO: 5 - protein, 11 aa, Artificial Sequence
  peptide construct
PSTHVLITHTI

SEQ ID NO: 6 - protein, 15 aa, Artificial Sequence
  peptide construct
DFLPHYKNTSLGHRP

SEQ ID NO: 7 - protein, 4 aa, Artificial Sequence
  peptide construct
GGGS

SEQ ID NO: 8 - protein, 5 aa, Artificial Sequence
  peptide construct
GGGSS

SEQ ID NO: 9 - protein, 5 aa, Artificial Sequence
  peptide construct
GGGGS

SEQ ID NO: 10 - protein, 6 aa, Artificial Sequence
  peptide construct
GGGGSS

SEQ ID NO: 11 - protein, 8 aa, Artificial Sequence
  peptide construct
GGGSGGGS

SEQ ID NO: 12 - protein, 8 aa, Artificial Sequence
  peptide construct
LRGGGGSS

SEQ ID NO: 13 - protein, 9 aa, Artificial Sequence
  peptide construct
VQGEESNDK

SEQ ID NO: 14 - protein, 37 aa, Artificial Sequence
  peptide construct
NGQEEKAGVVSTGLIGGGDSAFDVLSFTAEEKAGVYK

SEQ ID NO: 15 - protein, 15 aa, Homo sapiens
NGQEEKAGVVSTGLI

SEQ ID NO: 16 - protein, 19 aa, Artificial Sequence
  peptide construct
DSAFDVLSFTAEEKAGVYK

SEQ ID NO: 17 - protein, 60 aa, Artificial Sequence
  peptide construct
VLWKKQKDKVAELENSEGGGGSQAFTLLPSGDALPSLLRGGGGSSQVRLQPRGMGAHSPG

SEQ ID NO: 18 - protein, 9 aa, Artificial Sequence
  peptide construct
AYMTMKIRN

SEQ ID NO: 19 - protein, 17 aa, Artificial Sequence
  peptide construct
EIIVTHFPFDEQNCSMK

SEQ ID NO: 20 - protein, 31 aa, Artificial Sequence
  peptide construct
AYMTMKIRNGGGGSEIIVTHFPFDEQNCSMK

SEQ ID NO: 21 - protein, 7 aa, Artificial Sequence
  peptide construct
DQTQDTE

SEQ ID NO: 22 - protein, 29 aa, Artificial Sequence
  peptide construct
DQTQDTEGGGGSEIIVTHFPFDEQNCSMK

SEQ ID NO: 23 - protein, 27 aa, Artificial Sequence
  peptide construct
PSTHVLITHTIGGGIAGFKGEQGPKGE

SEQ ID NO: 24 - protein, 31 aa, Artificial Sequence
  peptide construct
DFLPHYKNTSLGHRPGGGIAGFKGEQGPKGE

SEQ ID NO: 25 - protein, 33 aa, Artificial Sequence
  peptide construct
NGQEEKAGVVSTGLIGGGGSIAGFKGEQGPKGE

SEQ ID NO: 26 - protein, 32 aa, Artificial Sequence
  peptide construct
DGQEEKAGVVSTGLIGGGGSIAGFKGEQGPKG

SEQ ID NO: 27 - protein, 31 aa, Homo sapiens
DNQLLETCKQDRLRNRRGNGSSTHFEGNLPC

SEQ ID NO: 28 - protein, 55 aa, Artificial Sequence
  peptide construct
DNQLLETCKQDRLRNRRGNGSSTHFEGNLPCGGGGSDSAFDVLSFTAEEKAGVYK

SEQ ID NO: 29 - protein, 26 aa, Artificial Sequence
  peptide construct
DQTQDTEGGGGSSVHFFKNIVTPRTP

SEQ ID NO: 30 - protein, 28 aa, Artificial Sequence
  peptide construct
DQTQDTEGGGGSSGDKVSFFCKNKEKKC

SEQ ID NO: 31 - protein, 30 aa, Artificial Sequence
  peptide construct
DQTQDTEGGGGSSYQQLNSERGVPNENIEN

SEQ ID NO: 32 - protein, 42 aa, Artificial Sequence
  peptide construct
VLWKKQKDKVAELENSEGGGGSSIQTQMKTYSDIDGKLVSEV

SEQ ID NO: 33 - protein, 36 aa, Artificial Sequence
  peptide construct
VLWKKQKDKVAELENSEGGGGSSVFIKRVSNVIIHG

SEQ ID NO: 34 - protein, 38 aa, Artificial Sequence
  peptide construct
VLWKKQKDKVAELENSEGGGGSSIASRRVDGIIAAYQN

SEQ ID NO: 35 - protein, 38 aa, Artificial Sequence
  peptide construct
VLWKKQKDKVAELENSEGGGGSSMKVTVAFNQFGPNRR

SEQ ID NO: 36 - protein, 42 aa, Artificial Sequence
  peptide construct
VLWKKQKDKVAELENSEGGGGSSIDIFASKNFHLQKNTIGTG

SEQ ID NO: 37 - protein, 35 aa, Artificial Sequence
  peptide construct
VLWKKQKDKVAELENSEGGGGSSYFVGKMYFNLID

SEQ ID NO: 38 - protein, 38 aa, Artificial Sequence
  peptide construct
DQTQDTEGGGGSSGIGAVLKVLTTGPALISWIKRKRQQ

SEQ ID NO: 39 - protein, 13 aa, Artificial Sequence
  peptide construct
VHFFKNIVTPRTP

SEQ ID NO: 40 - protein, 17 aa, Artificial Sequence
  peptide construct
YQQLNSERGVPNENIEN

SEQ ID NO: 41 - protein, 19 aa, Artificial Sequence
  peptide construct
IQTQMKTYSDIDGKLVSEV

SEQ ID NO: 42 - protein, 13 aa, Artificial Sequence
  peptide construct
VFIKRVSNVIIHG

SEQ ID NO: 43 - protein, 15 aa, Artificial Sequence
  peptide construct
MKVTVAFNQFGPNRR

SEQ ID NO: 44 - protein, 15 aa, Artificial Sequence
  peptide construct
IASRRVDGIIAAYQN

SEQ ID NO: 45 - protein, 19 aa, Artificial Sequence
  peptide construct
IDIFASKNFHLQKNTIGTG

SEQ ID NO: 46 - protein, 12 aa, Artificial Sequence
  peptide construct
YFVGKMYFNLID

SEQ ID NO: 47 - protein, 25 aa, Artificial Sequence
  peptide construct
GIGAVLKVLTTGPALISWIKRKRQQ

SEQ ID NO: 48 - protein, 15 aa, Homo sapiens
DGQEEKAGVVSTGLI

SEQ ID NO: 49 - protein, 13 aa, Homo sapiens
DLLKNGERIEKVE

SEQ ID NO: 50 - protein, 12 aa, Artificial Sequence
  peptide construct
GGGSGTGSGSGS

SEQ ID NO: 51 - protein, 40 aa, Homo sapiens
DAEFRHDSGYEVHHQKLVFFAEDVGSNKGAIIGLMVGGVV

SEQ ID NO: 52 - protein, 40 aa, Artificial
  peptide construct
  MISC_FEATURE (1)..(1): X is D and E for acidic amino acids
  MOD_RES (1)..(1): ACETYLATION
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F, W or Y for aromatic amino acids
  MISC_FEATURE (11)..(11): X is D and E for acidic amino acids
  MOD_RES (11)..(11): 4Abu
  MISC_FEATURE (12)..(12): X is I, L or V
  MISC_FEATURE (13)..(13): X is K, R or H for basic amino acids
  MISC_FEATURE (14)..(14): X is K, R or H for basic amino acids
  MISC_FEATURE (15)..(15): X is N or Q for amidated amino acids
  MISC_FEATURE (16)..(16): X is K, R or H for basic amino acids
  MISC_FEATURE (17)..(17): X is I, L or V
  MOD_RES (17)..(17): 4Abu
  MISC_FEATURE (18)..(18): X is I, L or V
  MISC_FEATURE (19)..(19): X is F, W or Y for aromatic amino acids
  MISC_FEATURE (20)..(20): X is F, W or Y for aromatic amino acids
  MISC_FEATURE (21)..(21): X is A or G
  MISC_FEATURE (22)..(22): X is D and E for acidic amino acids
  MOD_RES (22)..(22): GAMMA-CARBOXYGLUTAMIC ACID HYDROXYLATION
  MISC_FEATURE (23)..(23): X is D and E for acidic amino acids
  MISC_FEATURE (24)..(24): X is I, L or V
  MISC_FEATURE (25)..(25): X is A or G
  MISC_FEATURE (26)..(26): X is C or S
  MISC_FEATURE (27)..(27): X is N or Q for amidated amino acids
  MISC_FEATURE (28)..(28): X is K, R or H for basic amino acids
  MISC_FEATURE (29)..(29): X is A or G
  MISC_FEATURE (30)..(30): X is A or G
  MISC_FEATURE (31)..(31): X is I, L or V
  MOD_RES (31)..(31): 4Abu
  MISC_FEATURE (32)..(32): X is I, L or V
  MISC_FEATURE (33)..(33): X is A or G
  MISC_FEATURE (34)..(34): X is I, L or V
  MISC_FEATURE (35)..(35): X is M or Nle
  MISC_FEATURE (36)..(36): X is I, L or V
  MISC_FEATURE (37)..(37): X is A or G
  MISC_FEATURE (38)..(38): X is A or G
  MISC_FEATURE (39)..(39): X is I, L or V
  MOD_RES (39)..(39): 4Abu
  MISC_FEATURE (40)..(40): X is I, L or V
XXXXXXXXXXXXXXXXXXXXXXXXXXXXXXXXXXXXXXXX

SEQ ID NO: 53 - protein, 28 aa, Homo sapiens
DAEFRHDSGYEVHHQKLVFFAENVGSNK

SEQ ID NO: 54 - protein, 28 aa, Artificial
  peptide construct
  MISC_FEATURE (1)..(1): X is D and E for acidic amino acids
  MOD_RES (1)..(1): ACETYLATION
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F, W or Y for aromatic amino acids
  MISC_FEATURE (11)..(11): X is D and E for acidic amino acids
  MOD_RES (11)..(11): 4Abu
  MISC_FEATURE (12)..(12): X is I, L or V
  MISC_FEATURE (13)..(13): X is K, R or H for basic amino acids
  MISC_FEATURE (14)..(14): X is K, R or H for basic amino acids
  MISC_FEATURE (15)..(15): X is N or Q for amidated amino acids
  MISC_FEATURE (16)..(16): X is K, R or H for basic aminio acids
  MISC_FEATURE (17)..(17): X is I, L or V
  MOD_RES (17)..(17): 4Abu
  MISC_FEATURE (18)..(18): X is I, L or V
  MISC_FEATURE (19)..(19): X is F, W or Y for aromatic amino acids
  MISC_FEATURE (20)..(20): X is F, W or Y for aromatic amino acids
  MISC_FEATURE (21)..(21): X is A or G
  MISC_FEATURE (22)..(22): X is D and E for acidic amino acids
  MOD_RES (22)..(22): 4Abu
  MOD_RES (22)..(22): GAMMA-CARBOXYGLUTAMIC ACID HYDROXYLATION
  MISC_FEATURE (23)..(23): X is D and E for acidic amino acids
  MISC_FEATURE (24)..(24): X is I, L or V
  MISC_FEATURE (25)..(25): X is A or G
  MISC_FEATURE (26)..(26): X is C or S
  MISC_FEATURE (27)..(27): X is N or Q for amidated amino acids
  MISC_FEATURE (28)..(28): X is K, R or H for basic amino acids
XXXXXXXXXXXXXXXXXXXXXXXXXXXX

SEQ ID NO: 55 - protein, 30 aa, Homo sapiens
DAEFRHDSGYEVHHQKLVFFAENVGSNKAI

SEQ ID NO: 56 - protein, 30 aa, Artificial
  peptide construct
  MISC_FEATURE (1)..(1): X is D and E for acidic amino acids
  MOD_RES (1)..(1): ACETYLATION
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F, W or Y for aromatic amino acids
  MISC_FEATURE (11)..(11): X is D and E for acidic amino acids
  MOD_RES (11)..(11): 4Abu
  MISC_FEATURE (12)..(12): X is I, L or V
  MISC_FEATURE (13)..(13): X is K, R or H for basic amino acids
  MISC_FEATURE (14)..(14): X is K, R or H for basic amino acids
  MISC_FEATURE (15)..(15): X is N or Q for amidated amino acids
  MISC_FEATURE (16)..(16): X is K, R or H for basic amino acids
  MISC_FEATURE (17)..(17): X is I, L or V
  MOD_RES (17)..(17): 4Abu
  MISC_FEATURE (18)..(18): X is I, L or V
  MISC_FEATURE (19)..(19): X is F, W or Y for aromatic amino acids
  MISC_FEATURE (20)..(20): X is F, W or Y for aromatic amino acids
  MISC_FEATURE (21)..(21): X is A or G
  MISC_FEATURE (22)..(22): X is D and E for acidic amino acids
  MOD_RES (22)..(22): 4Abu
  MOD_RES (22)..(22): GAMMA-CARBOXYGLUTAMIC ACID HYDROXYLATION
  MISC_FEATURE (23)..(23): X is D and E for acidic amino acids
  MISC_FEATURE (24)..(24): X is I, L or V
  MISC_FEATURE (25)..(25): X is A or G
  MISC_FEATURE (26)..(26): X is C or S
  MISC_FEATURE (27)..(27): X is N or Q for amidated amino acids
  MISC_FEATURE (28)..(28): X is K, R or H for basic amino acids
  MISC_FEATURE (29)..(29): X is A or G
  MISC_FEATURE (30)..(30): X is I, L or V
XXXXXXXXXXXXXXXXXXXXXXXXXXXXXX

SEQ ID NO: 57 - protein, 11 aa, Artificial
  Completely synthesized peptide construct
DAEFRHDSGYE

SEQ ID NO: 58 - protein, 11 aa, Artificial
  peptide construct
  MISC_FEATURE (1)..(1): X is D and E for acidic amino acids
  MOD_RES (1)..(1): ACETYLATION
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F, W or Y for aromatic amino acids
  MISC_FEATURE (11)..(11): X is D and E for acidic amino acids
XXXXXXXXXXX

SEQ ID NO: 59 - protein, 7 aa, Artificial
  Completely synthesized peptide construct
ENVGSNK

SEQ ID NO: 60 - protein, 7 aa, Artificial
  peptide construct
  MISC_FEATURE (1)..(1): X is D and E for acidic amino acids
  MOD_RES (1)..(1): ACETYLATION
  MOD_RES (1)..(1): 4Abu
  MOD_RES (1)..(1): 4Abu
  MOD_RES (1)..(1): GAMMA-CARBOXYGLUTAMIC ACID HYDROXYLATION
  MISC_FEATURE (2)..(2): X is D and E for acidic amino acids
  MISC_FEATURE (3)..(3): X is I, L or V
  MISC_FEATURE (4)..(4): X is A or G
  MISC_FEATURE (5)..(5): X is C or S
  MISC_FEATURE (6)..(6): X is N or Q for amidated amino acids
  MISC_FEATURE (7)..(7): X is K, R or H for basic amino acids
XXXXXXX

SEQ ID NO: 61 - protein, 12 aa, Artificial
  Completely synthesized peptide construct
DAEFRHDSGYEV

SEQ ID NO: 62 - protein, 12 aa, Artificial
  peptide construct
  MISC_FEATURE (1)..(1): X is D and E for acidic amino acids
  MOD_RES (1)..(1): ACETYLATION
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F, W or Y for aromatic amino acids
  MISC_FEATURE (11)..(11): X is D and E for acidic amino acids
  MOD_RES (11)..(11): 4Abu
  MISC_FEATURE (12)..(12): X is I, L or V
XXXXXXXXXXXX

SEQ ID NO: 63 - protein, 10 aa, Artificial
  Completely synthesized peptide construct
DAEFRHDSGY

SEQ ID NO: 64 - protein, 10 aa, Artificial
  peptide construct
  MISC_FEATURE (1)..(1): X is D and E for acidic amino acids
  MOD_RES (1)..(1): ACETYLATION
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F, W or Y for aromatic amino acids
XXXXXXXXXX

SEQ ID NO: 65 - protein, 4 aa, Artificial
  Completely synthesized peptide construct
EFRH

SEQ ID NO: 66 - protein, 4 aa, Artificial
  peptide construct
  MISC_FEATURE (1)..(1): X is D and E for acidic amino acids
  MOD_RES (1)..(1): ACETYLATION
  MISC_FEATURE (2)..(2): X is F or P
  MISC_FEATURE (3)..(3): X is K, R or H for basic amino acids
  MISC_FEATURE (4)..(4): X is K, R or H for basic amino acids
XXXX

SEQ ID NO: 67 - protein, 19 aa, Artificial
  peptide construct
  MISC_FEATURE (1)..(1): X is D and E for acidic amino acids
  MOD_RES (1)..(1): ACETYLATION
  MISC_FEATURE (2)..(2): X is C or S
  MISC_FEATURE (3)..(3): X is A or G
  MISC_FEATURE (4)..(4): X is F, W or Y for aromatic amino acids
  MISC_FEATURE (5)..(5): X is D and E for acidic amino acids
  MOD_RES (5)..(5): GAMMA-CARBOXYGLUTAMIC ACID HYDROXYLATION
  MOD_RES (5)..(5): 4Abu
  MISC_FEATURE (6)..(6): X is I, L or V
  MISC_FEATURE (7)..(7): X is I, L or V
  MISC_FEATURE (8)..(8): X is C or S
  MISC_FEATURE (9)..(9): X is F, W or Y for aromatic amino acids
  MISC_FEATURE (10)..(10): X is T or S
  MISC_FEATURE (11)..(11): X is A or G
  MISC_FEATURE (12)..(12): X is D and E for acidic amino acids
  MOD_RES (12)..(12): 4Abu
  MISC_FEATURE (13)..(13): X is D and E for acidic amino acids
  MISC_FEATURE (14)..(14): X is K, R or H for basic amino acids
  MISC_FEATURE (15)..(15): X is A or G
  MISC_FEATURE (16)..(16): X is A or G
  MISC_FEATURE (17)..(17): X is I, L or V
  MISC_FEATURE (18)..(18): X is F, W or Y for aromatic amino acids
  MISC_FEATURE (19)..(19): X is K, R or H for basic amino acids
XXXXXXXXXXXXXXXXXXX

SEQ ID NO: 68 - protein, 14 aa, Artificial
  Completely synthesized peptide construct
  MOD_RES (1)..(1): ACETYLATION
SLKLMATLFSTYAS

SEQ ID NO: 69 - protein, 14 aa, Artificial
  Completely synthesized peptide construct
  MISC_FEATURE (1)..(1): X is C or S
  MISC_FEATURE (2)..(2): X is I, L or V
  MISC_FEATURE (3)..(3): X is K, R or H for basic amino acids
  MISC_FEATURE (4)..(4): X is I, L or V
  MISC_FEATURE (5)..(5): X is M or Nle
  MISC_FEATURE (6)..(6): X is A or G
  MISC_FEATURE (7)..(7): X is T or S
  MISC_FEATURE (8)..(8): X is I, L or V
  MISC_FEATURE (9)..(9): X is F or P
  MISC_FEATURE (10)..(10): X is C or S
  MISC_FEATURE (11)..(11): X is T or S
  MISC_FEATURE (12)..(12): X is F, W or Y for aromatic amino acids
  MISC_FEATURE (13)..(13): X is A or G
  MISC_FEATURE (14)..(14): X is C or S
XXXXXXXXXXXXXX

SEQ ID NO: 70 - protein, 14 aa, Artificial
  Completely synthesized peptide construct
  MOD_RES (1)..(1): ACETYLATION
SLKLMATLFSSYAT

SEQ ID NO: 71 - protein, 14 aa, Artificial
  Completely synthesized peptide construct
  MOD_RES (1)..(1): ACETYLATION
  MISC_FEATURE (1)..(1): X is S
  MISC_FEATURE (2)..(2): X is C or S
  MISC_FEATURE (3)..(3): X is I, L or V
  MISC_FEATURE (4)..(4): X is K, R or H for basic amino acids
  MISC_FEATURE (5)..(5): X is I, L or V
  MISC_FEATURE (6)..(6): X is M or Nle
  MISC_FEATURE (7)..(7): X is A or G
  MISC_FEATURE (8)..(8): X is Tor S
  MISC_FEATURE (9)..(9): X is I, L or V
  MISC_FEATURE (10)..(10): X is F or P
  MISC_FEATURE (11)..(11): X is C or S
  MISC_FEATURE (12)..(12): X is C or S
  MISC_FEATURE (13)..(13): X is F, W or Y for aromatic amino acids
  MISC_FEATURE (14)..(14): X is A or G
  MISC_FEATURE (15)..(15): X is T or S
XXXXXXXXXXXXXX

SEQ ID NO: 72 - protein, 11 aa, Homo sapiens
NITEIADLTQK

SEQ ID NO: 73 - protein, 11 aa, Artificial
  peptide construct
  MISC_FEATURE (1)..(1): X is N or Q for amidated amino acids
  MOD_RES (1)..(1): ACETYLATION
  MISC_FEATURE (2)..(2): X is I, L or V
  MISC_FEATURE (3)..(3): X is T or S
  MISC_FEATURE (4)..(4): X is D and E for acidic amino acids
  MOD_RES (4)..(4): 4Abu
  MISC_FEATURE (5)..(5): X is I, L or V
  MISC_FEATURE (6)..(6): X is A or G
  MISC_FEATURE (7)..(7): X is D and E for acidic amino acids
  MOD_RES (7)..(7): 4Abu
  MISC_FEATURE (8)..(8): X is I, L or V
  MISC_FEATURE (9)..(9): X is T or S
  MISC_FEATURE (10)..(10): X is N or Q for amidated amino acids
  MISC_FEATURE (11)..(11): X is K, R or H for basic amino acids
XXXXXXXXXXX

SEQ ID NO: 74 - protein, 40 aa, Homo sapiens
NMYAMMIARFKMFPEVKEKGMAALPRLIAFTSEHSHFSLK

SEQ ID NO: 75 - protein, 40 aa, Artificial; identical to SEQ ID NO: 52
  peptide construct
  MISC_FEATURE (1)..(1): X is N or Q for amidated amino acids
  MOD_RES (1)..(1): ACETYLATION
  MISC_FEATURE (2)..(2): X is M or Nle
  MISC_FEATURE (3)..(3): X is F, W or Y for aromatic amino acids
  MISC_FEATURE (4)..(4): X is A or G
  MISC_FEATURE (5)..(5): X is M or Nle
  MISC_FEATURE (6)..(6): X is M or Nle
  MISC_FEATURE (7)..(7): X is I, L or V
  MISC_FEATURE (8)..(8): X is A or G
  MISC_FEATURE (9)..(9): X is K, R or H for basic amino acids
  MISC_FEATURE (10)..(10): X is F, W or Y for aromatic amino acids
  MISC_FEATURE (11)..(11): X is K, R or H for basic amino acids
  MISC_FEATURE (12)..(12): X is M or Nle
  MISC_FEATURE (13)..(13): X is F, W or Y for aromatic amino acids
  MISC_FEATURE (14)..(14): X is F or P
  MISC_FEATURE (15)..(15): X is D and E for acidic amino acids
  MOD_RES (15)..(15): 4Abu
  MISC_FEATURE (16)..(16): X is I, L or V
  MISC_FEATURE (17)..(17): X is K, R or H for basic amino acids
  MISC_FEATURE (18)..(18): X is D and E for acidic amino acids
  MISC_FEATURE (19)..(19): X is K, R or H for basic amino acids
  MISC_FEATURE (20)..(20): X is A or G
  MISC_FEATURE (21)..(21): X is M or Nle
  MISC_FEATURE (22)..(22): X is A or G
  MISC_FEATURE (23)..(23): X is A or G
  MISC_FEATURE (24)..(24): X is I, L or V
  MISC_FEATURE (25)..(25): X is F or P
  MISC_FEATURE (26)..(26): X is K, R or H for basic amino acids
  MISC_FEATURE (27)..(27): X is I, L or V
  MOD_RES (27)..(27): 4Abu
  MISC_FEATURE (28)..(28): X is I, L or V
  MISC_FEATURE (29)..(29): X is A or G
  MISC_FEATURE (30)..(30): X is F, W or Y for aromatic amino acids
  MISC_FEATURE (31)..(31): X is T or S
  MISC_FEATURE (32)..(32): X is C or S
  MISC_FEATURE (33)..(33): X is D and E for acidic amino acids
  MISC_FEATURE (34)..(34): X is K, R or H for basic amino acids
  MISC_FEATURE (35)..(35): X is C or S
  MISC_FEATURE (36)..(36): X is K, R or H for basic amino acids
  MISC_FEATURE (37)..(37): X is F, W or Y for aromatic amino acids
  MISC_FEATURE (38)..(38): X is C or S
  MISC_FEATURE (39)..(39): X is I, L or V
  MISC_FEATURE (40)..(40): X is K, R or H for basic amino acids

SEQ ID NO: 76 - protein, 34 aa, Homo sapiens
IARFKMFPEVKEKGMAALPRLIAFTSEHSHFSLK

SEQ ID NO: 77 - protein, 34 aa, Artificial
  peptide construct
  MISC_FEATURE (1)..(1): X is I, L or V
  MOD_RES (1)..(1): ACETYLATION
  MISC_FEATURE (2)..(2): X is A or G
  MISC_FEATURE (3)..(3): X is K, R or H for basic amino acids
  MISC_FEATURE (4)..(4): X is F, W or Y or aromatic amino acids
  MISC_FEATURE (5)..(5): X is K, R or H for basic amino acids
  MISC_FEATURE (6)..(6): X is M or Nle
  MISC_FEATURE (7)..(7): X is F,  W or Y for aromatic amino acids
  MISC_FEATURE (8)..(8): X is F or P
  MISC_FEATURE (9)..(9): X is D and E for acidic amino acids
  MISC_FEATURE (10)..(10): X is I, L or V
  MISC_FEATURE (11)..(11): X is K, R or H for basic amino acids
  MISC_FEATURE (12)..(12): X is D and E for acidic amino acids
  MISC_FEATURE (13)..(13): X is K, R or H for basic amino acids
  MISC_FEATURE (14)..(14): X is A or G
  MISC_FEATURE (15)..(15): X is M or Nle
  MISC_FEATURE (16)..(16): X is A or G
  MISC_FEATURE (17)..(17): X is A or G
  MISC_FEATURE (18)..(18): X is I, L or V
  MISC_FEATURE (19)..(19): X is  F or P
  MISC_FEATURE (20)..(20): X is K, R or H for basic amino acids
  MISC_FEATURE (21)..(21): X is I, L or V
  MOD_RES (21)..(21): 4Abu
  MISC_FEATURE (22)..(22): X is I, L or V
  MISC_FEATURE (23)..(23): X is A or G
  MISC_FEATURE (24)..(24): X is F, W or Y for aromatic amino acids
  MISC_FEATURE (25)..(25): X is T or S
  MISC_FEATURE (26)..(26): X is C or S
  MISC_FEATURE (27)..(27): X is D and E for acidic amino acids
  MISC_FEATURE (28)..(28): X is K, R or H for basic amino acids
  MISC_FEATURE (29)..(29): X is C or S
  MISC_FEATURE (30)..(30): X is K, R or H for basic amino acids
  MISC_FEATURE (31)..(31): X is F, W or Y for aromatic amino acids
  MISC_FEATURE (32)..(32): X is C or S
  MISC_FEATURE (33)..(33): X is C or S
  MISC_FEATURE (34)..(34): X is I, L or V
  MISC_FEATURE (35)..(35): X is K, R or H for basic amino acids
XXXXXXXXXXXXXXXXXXXXXXXXXXXXXXXXXX

SEQ ID NO: 78 - protein, 20 aa, Homo sapiens
SRLSKVAPVIKARMMEYGTT

SEQ ID NO: 79 - protein, 20 aa, Artificial
  Completely synthesized peptide construct
  MISC_FEATURE (1)..(1): X is C or S
  MOD_RES (1)..(1): ACETYLATION
  MISC_FEATURE (2)..(2): X is K, R or H for basic amino acids
  MISC_FEATURE (3)..(3): X is I, L or V
  MISC_FEATURE (4)..(4): X is C or S
  MISC_FEATURE (5)..(5): X is K, R or H for basic amino acids
  MISC_FEATURE (6)..(6): X is I, L or V
  MISC_FEATURE (7)..(7): X is A or G
  MISC_FEATURE (8)..(8): X is F or P
  MISC_FEATURE (9)..(9): X is I, L or V
  MISC_FEATURE (10)..(10): X is I, L or V
  MISC_FEATURE (11)..(11): X is K, R or H for basic amino acids
  MISC_FEATURE (12)..(12): X is A or G
  MISC_FEATURE (13)..(13): X is K, R or H for basic amino acids
  MISC_FEATURE (14)..(14): X is M or Nle
  MISC_FEATURE (15)..(15): X is M or Nle
  MISC_FEATURE (16)..(16): X is D or E for  acidic amino acids
  MISC_FEATURE (17)..(17): X is F, W or Y for aromatic amino acids
  MISC_FEATURE (18)..(18): X is A or G
  MISC_FEATURE (19)..(19): X is T or S
  MISC_FEATURE (20)..(20): X is T or S
XXXXXXXXXXXXXXXXXXXX

SEQ ID NO: 80 - protein, 19 aa, Homo sapiens
IPPSLRYLEDEERMSRLSK

SEQ ID NO: 81 - protein, 18 aa, Artificial
  peptide construct
  MISC_FEATURE (1)..(1): X is I, L or V
  MOD_RES (1)..(1): acetylation
  MOD_RES (1)..(1): GAMMA-CARBOXYGLUTAMIC ACID HYDROXYLATION
  MISC_FEATURE (2)..(2): X is F or P
  MISC_FEATURE (3)..(3): X is F or P
  MISC_FEATURE (4)..(4): X is C or S
  MISC_FEATURE (5)..(5): X is I, L or V
  MISC_FEATURE (6)..(6): X is K, R or H for basic amino acids
  MISC_FEATURE (7)..(7): X is F, W or Y for aromatic amino acids
  MISC_FEATURE (8)..(8): X is D and E for acidic amino acids
  MISC_FEATURE (9)..(9): X is D and E for acidic amino acids
  MISC_FEATURE (10)..(10): X is D and E for acidic amino acids
  MISC_FEATURE (11)..(11): X is D and E for acidic amino acids
  MISC_FEATURE (12)..(12): X is K, R or H for basic amino acids
  MISC_FEATURE (13)..(13): X is M or Nle
  MISC_FEATURE (14)..(14): X is C or S
  MISC_FEATURE (15)..(15): X is K, R or H for basic amino acids
  MISC_FEATURE (16)..(16): X is I, L or V
  MISC_FEATURE (17)..(17): X is C or S
  MISC_FEATURE (18)..(18): X is K, R or H for basic amino acids
XXXXXXXXXXXXXXXXXX

SEQ ID NO: 82 - protein, 20 aa, Homo sapiens
NTNMFTYEIAPVFVLLEYVT

SEQ ID NO: 83 - protein, 20 aa, Artificial
  peptide construct
  MISC_FEATURE (1)..(1): X is N or Q for amidated amino acids
  MOD_RES (1)..(1): ACETYLATION
  MISC_FEATURE (2)..(2): X is T or S
  MISC_FEATURE (3)..(3): X is N or Q for amidated amino acids
  MISC_FEATURE (4)..(4): X is M or Nle
  MISC_FEATURE (5)..(5): X is F, W or Y for aromatic amino acids
  MISC_FEATURE (6)..(6): X is T or S
  MISC_FEATURE (7)..(7): X is F, W or Y for aromatic amino acids
  MISC_FEATURE (8)..(8): X is D and E for acidic amino acids
  MOD_RES (8)..(8): 4Abu
  MISC_FEATURE (9)..(9): X is I, L or V
  MISC_FEATURE (10)..(10): X is A or G
  MISC_FEATURE (11)..(11): X is F or P
  MISC_FEATURE (12)..(12): X is I, L or V
  MISC_FEATURE (13)..(13): X is F, W or Y for aromatic amino acids
  MISC_FEATURE (14)..(14): X is I, L or V
  MOD_RES (14)..(14): 4Abu
  MOD_RES (14)..(14): 4Abu
  MOD_RES (14)..(14): GAMMA-CARBOXYGLUTAMIC ACID HYDROXYLATION
  MISC_FEATURE (15)..(15): X is I, L or V
  MISC_FEATURE (16)..(16): X is I, L or V
  MISC_FEATURE (17)..(17): X is D and E for acidic amino acids
  MISC_FEATURE (18)..(18): X is F, W or Y for aromatic amino acids
  MISC_FEATURE (19)..(19): X is I, L or V
  MISC_FEATURE (20)..(20): X is T or S
XXXXXXXXXXXXXXXXXXXX

SEQ ID NO: 84 - protein, 15 aa, Homo sapiens
FKADEKKFWGKYLYE

SEQ ID NO: 85 - protein, 15 aa, Artificial
  peptide construct
  MISC_FEATURE (1)..(1): X is F, W or Y for aromatic amino acids
  MOD_RES (1)..(1): ACETYLATION
  MISC_FEATURE (2)..(2): X is K, R or H for basic amino acids
  MISC_FEATURE (3)..(3): X is A or G
  MISC_FEATURE (4)..(4): X is D and E for acidic amino acids
  MOD_RES (4)..(4): 4Abu
  MISC_FEATURE (5)..(5): X is D and E for acidic amino acids
  MISC_FEATURE (6)..(6): X is K, R or H for basic amino acids
  MISC_FEATURE (7)..(7): X is K, R or H for basic amino acids
  MISC_FEATURE (8)..(8): X is F, W or Y for aromatic amino acids
  MISC_FEATURE (9)..(9): X is F, W or Y for aromatic amino acids
  MISC_FEATURE (10)..(10): X is A or G
  MISC_FEATURE (11)..(11): X is K, R or H for basic amino acids
  MISC_FEATURE (12)..(12): X is F, W or Y for aromatic amino acids
  MISC_FEATURE (13)..(13): X is I, L or V
  MISC_FEATURE (14)..(14): X is F, W or Y for aromatic amino acids
  MISC_FEATURE (15)..(15): X is D and E for acidic amino acids
XXXXXXXXXXXXXXX

SEQ ID NO: 86 - protein, 15 aa, Homo sapiens
SHLVEALYLVCGERG

SEQ ID NO: 87 - protein, 14 aa, Artificial
  peptide construct
  MISC_FEATURE (1)..(1): X is C or S
  MOD_RES (1)..(1): ACETYLATION
  MISC_FEATURE (2)..(2): X is K, R or H for basic amino acids
  MISC_FEATURE (3)..(3): X is I, L or V
  MOD_RES (3)..(3): 4Abu
  MOD_RES (3)..(3): GAMMA-CARBOXYGLUTAMIC ACID HYDROXYLATION
  MISC_FEATURE (4)..(4): X is I, L or V
  MISC_FEATURE (5)..(5): X is D and E for acidic amino acids
  MISC_FEATURE (6)..(6): X is  A or G
  MISC_FEATURE (7)..(7): X is I, L or V
  MISC_FEATURE (8)..(8): X is F, W or Y for aromatic amino acids
  MISC_FEATURE (9)..(9): X is I, L or V
  MISC_FEATURE (10)..(10): X is C or S
  MISC_FEATURE (11)..(11): X is A or G
  MISC_FEATURE (12)..(12): X is D and E for acidic amino acids
  MISC_FEATURE (13)..(13): X is K, R or H for basic amino acids
  MISC_FEATURE (14)..(14): X is A or G
XXXXXXXXXXXXXX

SEQ ID NO: 88 - protein, 24 aa, Homo sapiens
VLGGGCALLRCIPALDSLTPANED

SEQ ID NO: 89 - protein, 24 aa, Artificial
  peptide construct
  MISC_FEATURE (1)..(1): X is I, L or V
  MOD_RES (1)..(1): ACETYLATION
  MOD_RES (1)..(1): 4Abu
  MISC_FEATURE (2)..(2): X is I, L or V
  MISC_FEATURE (3)..(3): X is A or G
  MISC_FEATURE (4)..(4): X is A or G
  MISC_FEATURE (5)..(5): X is A or G
  MISC_FEATURE (6)..(6): X is C or S
  MISC_FEATURE (7)..(7): X is A or G
  MISC_FEATURE (8)..(8): X is I, L or V
  MOD_RES (8)..(8): 4Abu
  MISC_FEATURE (9)..(9): X is I, L or V
  MISC_FEATURE (10)..(10): X is K, R or H for basic amino acids
  MISC_FEATURE (11)..(11): X is  C or S
  MISC_FEATURE (12)..(12): X is I, L or V
  MISC_FEATURE (13)..(13): X is F or P
  MISC_FEATURE (14)..(14): X is A or G
  MISC_FEATURE (15)..(15): X is I, L or V
  MOD_RES (15)..(15): 4Abu
  MISC_FEATURE (16)..(16): X is D and E for acidic amino acids
  MISC_FEATURE (17)..(17): X is C or S
  MISC_FEATURE (18)..(18): X is I, L or V
  MISC_FEATURE (19)..(19): X is T or S
  MISC_FEATURE (20)..(20): X is F or P
  MISC_FEATURE (21)..(21): X is A or G
  MISC_FEATURE (22)..(22): X is N or Q for amidated amino acids
  MISC_FEATURE (23)..(23): X is D and E for acidic amino acids
  MOD_RES (23)..(23): 4Abu
  MISC_FEATURE (24)..(24): X is D and E for acidic amino acids
XXXXXXXXXXXXXXXXXXXXXXXX

SEQ ID NO: 90 - protein, 28 aa, Homo sapiens
EACVTSWLWSGEGAVFYRVDLHFINLGT

SEQ ID NO: 91 - protein, 28 aa, Artificial
  peptide construct
  MISC_FEATURE (1)..(1): X is D and E for acidic amino acids
  MOD_RES (1)..(1): ACETYLATION
  MISC_FEATURE (2)..(2): X is A or G
  MISC_FEATURE (3)..(3): X is C or S
  MISC_FEATURE (4)..(4): X is I, L or V
  MISC_FEATURE (5)..(5): X is T or S
  MISC_FEATURE (6)..(6): X is C or S
  MISC_FEATURE (7)..(7): X is F, W or Y for aromatic amino acids
  MISC_FEATURE (8)..(8): X is I, L or V
  MISC_FEATURE (9)..(9): X is F, W or Y for aromatic amino acids
  MISC_FEATURE (10)..(10): X is C or S
  MISC_FEATURE (11)..(11): X is A or G
  MISC_FEATURE (12)..(12): X is D and E for acidic amino acids
  MISC_FEATURE (13)..(13): X is A or G
  MISC_FEATURE (14)..(14): X is A or G
  MISC_FEATURE (15)..(15): X is I,  L or V
  MISC_FEATURE (16)..(16): X is F, W or Y for aromatic amino acids
  MISC_FEATURE (17)..(17): X is F, W or Y for aromatic amino acids
  MISC_FEATURE (18)..(18): X is K, R or H for basic amino acids
  MISC_FEATURE (19)..(19): X is I, L or V
  MOD_RES (19)..(19): 4Abu
  MOD_RES (19)..(19): GAMMA-CARBOXYGLUTAMIC ACID HYDROXYLATION
  MISC_FEATURE (20)..(20): X is D and E for acidic amino acids
  MISC_FEATURE (21)..(21): X is I, L or V
  MISC_FEATURE (22)..(22): X is K, R or H for basic amino acids
  MISC_FEATURE (23)..(23): X is F, W or Y for aromatic amino acids
  MISC_FEATURE (24)..(24): X is I, L or V
  MISC_FEATURE (25)..(25): X is N or Q for amidated amino acids
  MISC_FEATURE (26)..(26): X is I, L or V
  MISC_FEATURE (27)..(27): X is  A or G
  MISC_FEATURE (28)..(28): X is T or S
XXXXXXXXXXXXXXXXXXXXXXXXXXXX

SEQ ID NO: 92 - protein, 21 aa, Homo sapiens
MDFWCVEHDRPPPATPTSLTT

SEQ ID NO: 93 - protein, 21 aa, Artificial
  peptide construct
  MISC_FEATURE (1)..(1): X is M or Nle
  MOD_RES (1)..(1): ACETYLATION
  MISC_FEATURE (2)..(2): X is D and E for acidic amino acids
  MISC_FEATURE (3)..(3): X is F, W or Y for aromatic amino acids
  MISC_FEATURE (4)..(4): X is F, W or Y for aromatic amino acids
  MISC_FEATURE (5)..(5): X is C or S
  MISC_FEATURE (6)..(6): X is I, L or V
  MOD_RES (6)..(6): 4Abu
  MISC_FEATURE (7)..(7): X is D and E for acidic amino acids
  MISC_FEATURE (8)..(8): X is K, R or H for basic amino acids
  MISC_FEATURE (9)..(9): X is D and E for acidic amino acids
  MISC_FEATURE (10)..(10): X is K, R or H for basic amino acids
  MISC_FEATURE (11)..(11): X is F or P
  MISC_FEATURE (12)..(12): X is F or P
  MISC_FEATURE (13)..(13): X is F or P
  MISC_FEATURE (14)..(14): X is A or G
  MISC_FEATURE (15)..(15): X is T or S
  MISC_FEATURE (16)..(16): X is F or P
  MISC_FEATURE (17)..(17): X is T or S
  MISC_FEATURE (18)..(18): X is  C or S
  MISC_FEATURE (19)..(19): X is I, L or V
  MISC_FEATURE (20)..(20): X is T or S
  MISC_FEATURE (21)..(21): X is T or S
XXXXXXXXXXXXXXXXXXXXX

SEQ ID NO: 94 - protein, 20 aa, Artificial
  Completely synthesized peptide construct
NMYAMMIARFKMFPEVKEKG

SEQ ID NO: 95 - protein, 20 aa, Artificial
  peptide construct
  MISC_FEATURE (1)..(1): X is N or Q for amidated amino acids
  MOD_RES (1)..(1): ACETYLATION
  MISC_FEATURE (2)..(2): X is M or Nle
  MISC_FEATURE (3)..(3): X is F, W or Y for aromatic amino acids
  MISC_FEATURE (4)..(4): X is A or G
  MISC_FEATURE (5)..(5): X is M or Nle
  MISC_FEATURE (6)..(6): X is M or Nle
  MISC_FEATURE (7)..(7): X is I, L or V
  MISC_FEATURE (8)..(8): X is A or G
  MISC_FEATURE (9)..(9): X is K, R or H for basic amino acids
  MISC_FEATURE (10)..(10): X is F, W or Y for aromatic amino acids
  MISC_FEATURE (11)..(11): X is K, R or H for basic amino acids
  MISC_FEATURE (12)..(12): X is M or Nle
  MISC_FEATURE (13)..(13): X is F, W or Y for aromatic amino acids
  MISC_FEATURE (14)..(14): X is F or P
  MISC_FEATURE (15)..(15): X is D and E for acidic amino acids
  MOD_RES (15)..(15): 4Abu
  MISC_FEATURE (16)..(16): X is I, L or V
  MISC_FEATURE (17)..(17): X is K, R or H for basic amino acids
  MISC_FEATURE (18)..(18): X is D and E for acidic amino acids
  MISC_FEATURE (19)..(19): X is K, R or H for basic amino acids
  MISC_FEATURE (20)..(20): X is  A or G
XXXXXXXXXXXXXXXXXXXX

SEQ ID NO: 96 - protein, 33 aa, Artificial
  Completely synthesized peptide construct
NMYAMMIARFKMFPEVKEKGMAALPRLIAFTSE

SEQ ID NO: 97 - protein, 33 aa, Artificial
  peptide construct
  MISC_FEATURE (1)..(1): X is N or Q for amidated amino acids
  MOD_RES (1)..(1): ACETYLATION
  MISC_FEATURE (1)..(1): X is N or Q for amidated amino acids
  MISC_FEATURE (2)..(2): X is M or Nle
  MISC_FEATURE (3)..(3): X is F, W or Y for aromatic amino acids
  MISC_FEATURE (4)..(4): X is A or G
  MISC_FEATURE (5)..(5): X is M or Nle
  MISC_FEATURE (6)..(6): X is M or Nle
  MISC_FEATURE (7)..(7): X is I, L or V
  MISC_FEATURE (8)..(8): X is A or G
  MISC_FEATURE (9)..(9): X is K, R or H for basic amino acids
  MISC_FEATURE (10)..(10): X is F, W or Y for aromatic amino acids
  MISC_FEATURE (11)..(11): X is K, R or H for basic amino acids
  MISC_FEATURE (12)..(12): X is M or Nle
  MISC_FEATURE (13)..(13): X is F, W or Y for aromatic amino acids
  MISC_FEATURE (14)..(14): X is F or P
  MISC_FEATURE (15)..(15): X is D and E for acidic amino acids
  MOD_RES (15)..(15): 4Abu
  MISC_FEATURE (16)..(16): X is I, L or V
  MISC_FEATURE (17)..(17): X is K, R or H for basic amino acids
  MISC_FEATURE (18)..(18): X is D and E for acidic amino acids
  MISC_FEATURE (19)..(19): X is K, R or H for basic amino acids
  MISC_FEATURE (20)..(20): X is A or G
  MISC_FEATURE (21)..(21): X is M or Nle
  MISC_FEATURE (22)..(22): X is A or G
  MISC_FEATURE (23)..(23): X is A or G
  MISC_FEATURE (24)..(24): X is I, L or V
  MISC_FEATURE (25)..(25): X is F or P
  MISC_FEATURE (26)..(26): X is K, R or H for basic amino acids
  MISC_FEATURE (27)..(27): X is I, L or V
  MOD_RES (27)..(27): 4Abu
  MISC_FEATURE (28)..(28): X is I, L or V
  MISC_FEATURE (29)..(29): X is A or G
  MISC_FEATURE (30)..(30): X is F, W or Y or aromatic amino acids
  MISC_FEATURE (31)..(31): X is T or S
  MISC_FEATURE (32)..(32): X is C or S
  MISC_FEATURE (33)..(33): X is D and E for acidic amino acids
XXXXXXXXXXXXXXXXXXXXXXXXXXXXXXXXX

SEQ ID NO: 98 - protein, 13 aa, Homo sapiens
IAFTSEHSHFSLK

SEQ ID NO: 99 - protein, 13 aa, Artificial
  peptide construct
  MISC_FEATURE (1)..(1): X is I, L or V
  MOD_RES (1)..(1): ACETYLATION
  MISC_FEATURE (2)..(2): X is A or G
  MISC_FEATURE (3)..(3): X is F, W or Y for aromatic amino acids
  MISC_FEATURE (4)..(4): X is T or S
  MISC_FEATURE (5)..(5): X is C or S
  MISC_FEATURE (6)..(6): X is D and  E for acidic amino acids
  MISC_FEATURE (7)..(7): X is K, R or H for basic amino acids
  MISC_FEATURE (8)..(8): X is C or S
  MISC_FEATURE (9)..(9): X is K, R or H for basic amino acids
  MISC_FEATURE (10)..(10): X is F, W or Y for aromatic amino acids
  MISC_FEATURE (11)..(11): X is C or S
  MISC_FEATURE (12)..(12): X is I, L or V
  MISC_FEATURE (13)..(13): X is K,  R or H for basic amino acids
XXXXXXXXXXXXX

SEQ ID NO: 100 - protein, 21 aa, Artificial
  peptide construct
  MISC_FEATURE (1)..(1): X is M or Nle
  MOD_RES (1)..(1): ACETYLATION
  MISC_FEATURE (2)..(2): X is D and E for acidic amino acids
  MISC_FEATURE (3)..(3): X is F, W or Y for aromatic amino acids
  MISC_FEATURE (4)..(4): X is F, W or Y for aromatic amino acids
  MISC_FEATURE (5)..(5): X is C or S
  MISC_FEATURE (6)..(6): X is I, L or V
  MOD_RES (6)..(6): 4Abu
  MISC_FEATURE (7)..(7): X is D and E for acidic amino acids
  MISC_FEATURE (8)..(8): X is K, R or H for basic amino acids
  MISC_FEATURE (9)..(9): X is D and E for acidic amino acids
  MISC_FEATURE (10)..(10): X is K, R or H for basic amino acids
  MISC_FEATURE (11)..(11): X is F or P
  MISC_FEATURE (12)..(12): X is F or P
  MISC_FEATURE (13)..(13): X is F or P
  MISC_FEATURE (14)..(14): X is A or G
  MISC_FEATURE (15)..(15): X is Tor S
  MISC_FEATURE (16)..(16): X is F or P
  MISC_FEATURE (17)..(17): X is T or S
  MISC_FEATURE (18)..(18): X is C or S
  MISC_FEATURE (19)..(19): X is I, L or V
  MISC_FEATURE (20)..(20): X is T or S
  MISC_FEATURE (21)..(21): X is T or S
XXXXXXXXXXXXXXXXXXXXX

SEQ ID NO: 101 - protein, 10 aa, Artificial
  Completely synthesized peptide construct
ERPTLAFLQD

SEQ ID NO: 102 - protein, 10 aa, Artificial
  peptide construct
  MISC_FEATURE (1)..(1): X is D and E for acidic amino acids
  MOD_RES (1)..(1): ACETYLATION
  MISC_FEATURE (2)..(2): X is K, R or H for basic amino acids
  MISC_FEATURE (3)..(3): X is F or P
  MISC_FEATURE (4)..(4): X is T or S
  MISC_FEATURE (5)..(5): X is I, L or V
  MISC_FEATURE (6)..(6): X is A or G
  MISC_FEATURE (7)..(7): X is F, W or Y for aromatic amino acids
  MISC_FEATURE (8)..(8): X is I,  L or V
  MISC_FEATURE (9)..(9): X is N or Q for amidated amino acids
  MISC_FEATURE (10)..(10): X is D and E for acidic amino acids
XXXXXXXXXX

SEQ ID NO: 103 - protein, 10 aa, Homo sapiens
DRSTKVIDFH

SEQ ID NO: 104 - protein, 10 aa, Artificial
  peptide construct
  MISC_FEATURE (1)..(1): X is D and E for acidic amino acids
  MOD_RES (1)..(1): ACETYLATION
  MISC_FEATURE (2)..(2): X is K, R or H for basic amino acids
  MISC_FEATURE (3)..(3): X is C  or S
  MISC_FEATURE (4)..(4): X is T or S
  MISC_FEATURE (5)..(5): X is K, R or H for basic amino acids
  MISC_FEATURE (6)..(6): X is I, L or V
  MOD_RES (6)..(6): 4Abu
  MOD_RES (6)..(6): GAMMA-CARBOXYGLUTAMIC ACID HYDROXYLATION
  MISC_FEATURE (7)..(7): X is I, L or V
  MISC_FEATURE (8)..(8): X is  D and E for acidic amino acids
  MISC_FEATURE (9)..(9): X is F, W or Y for aromatic amino acids
  MISC_FEATURE (10)..(10): X is K, R or H for basic amino acids
XXXXXXXXXX

SEQ ID NO: 105 - protein, 13 aa, Artificial
  peptide construct
  MISC_FEATURE (1)..(1): X is I, L or V
  MOD_RES (1)..(1): ACETYLATION
  MISC_FEATURE (2)..(2): X is A or G
  MISC_FEATURE (3)..(3): X is A or G
  MISC_FEATURE (4)..(4): X is F,  W or Y for aromatic amino acids
  MISC_FEATURE (5)..(5): X is K, R or H for basic amino acids
  MISC_FEATURE (6)..(6): X is A or G
  MISC_FEATURE (7)..(7): X is D and E for acidic amino acids
  MISC_FEATURE (8)..(8): X is N or Q for amidated amino acids
  MISC_FEATURE (9)..(9): X is A or G
  MISC_FEATURE (10)..(10): X is F or P
  MISC_FEATURE (11)..(11): X is K, R or H for basic amino acids
  MISC_FEATURE (12)..(12): X is A or G
  MISC_FEATURE (13)..(13): X is D and E for acidic amino acids
XXXXXXXXXXXXX

SEQ ID NO: 106 - protein, 8 aa, Artificial
  peptide construct
  MISC_FEATURE (1)..(1): X is K, R or H for basic amino acids
  MOD_RES (1)..(1): ACETYLATION
  MISC_FEATURE (2)..(2): X is N or Q for amidated amino acids
  MISC_FEATURE (3)..(3): X is I, L or V
  MOD_RES (3)..(3): 4Abu
  MISC_FEATURE (4)..(4): X is I, L or V
  MISC_FEATURE (5)..(5): X is T or S
  MISC_FEATURE (6)..(6): X is  F or P
  MISC_FEATURE (7)..(7): X is K, R or H for basic amino acids
  MISC_FEATURE (8)..(8): X is T or S
XXXXXXXX

SEQ ID NO: 107 - protein, 15 aa, Artificial
  peptide construct
  MISC_FEATURE (1)..(1): X is A or G
  MOD_RES (1)..(1): ACETYLATION
  MISC_FEATURE (2)..(2): X is D and E for acidic amino acids
  MISC_FEATURE (3)..(3): X is K, R or H for basic amino acids
  MISC_FEATURE (4)..(4): X is I, L or V
  MISC_FEATURE (5)..(5): X is C or S
  MISC_FEATURE (6)..(6): X is F, W or Y for aromatic amino acids
  MISC_FEATURE (7)..(7): X is F, W or Y for aromatic amino acids
  MISC_FEATURE (8)..(8): X is C or S
  MISC_FEATURE (9)..(9): X is K, R or H for basic amino acids
  MISC_FEATURE (10)..(10): X is N or Q for amidated amino acids
  MISC_FEATURE (11)..(11): X is K, R or H for basic amino acids
  MISC_FEATURE (12)..(12): X is D and E for acidic amino acids
  MISC_FEATURE (13)..(13): X is K, R or H for basic amino acids
  MISC_FEATURE (14)..(14): X is K, R or H for basic amino acids
  MISC_FEATURE (15)..(15): X is C or S
XXXXXXXXXXXXXXX

SEQ ID NO: 108 - protein, 17 aa, Artificial
  peptide construct
  MISC_FEATURE (1)..(1): X is D and E for acidic amino acids
  MOD_RES (1)..(1): ACETYLATION
  MOD_RES (1)..(1): 4Abu
  MOD_RES (1)..(1): 4Abu
  MOD_RES (1)..(1): GAMMA-CARBOXYGLUTAMIC ACID HYDROXYLATION
  MISC_FEATURE (2)..(2): X is I, L or V
  MISC_FEATURE (3)..(3): X is I, L or V
  MISC_FEATURE (4)..(4): X is I, L or V
  MISC_FEATURE (5)..(5): X is T or S
  MISC_FEATURE (6)..(6): X is K, R or H for basic amino acids
  MISC_FEATURE (7)..(7): X is F, W or Y for aromatic amino acids
  MISC_FEATURE (8)..(8): X is F or P
  MISC_FEATURE (9)..(9): X is F, W or Y for aromatic amino acids
  MISC_FEATURE (10)..(10): X is D and E for acidic amino acids
  MOD_RES (10)..(10): 4Abu
  MOD_RES (10)..(10): 4Abu
  MISC_FEATURE (11)..(11): X is D and E for acidic amino acids
  MISC_FEATURE (12)..(12): X is N or Q for amidated amino acids
  MISC_FEATURE (13)..(13): X is N or Q for amidated amino acids
  MISC_FEATURE (14)..(14): X is C or S
  MISC_FEATURE (15)..(15): X is C or S
  MISC_FEATURE (16)..(16): X is M or Nle
  MISC_FEATURE (17)..(17): X is K, R or H for basic amino acids
XXXXXXXXXXXXXXXXX

SEQ ID NO: 109 - protein, 13 aa, Artificial
  peptide construct
  MISC_FEATURE (1)..(1): X is I, L or V
  MOD_RES (1)..(1): ACETYLATION
  MISC_FEATURE (2)..(2): X is K, R or H for basic amino acids
  MISC_FEATURE (3)..(3): X is F, W or Y for aromatic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is N or Q for amidated amino acids
  MISC_FEATURE (7)..(7): X is I, L or V
  MOD_RES (7)..(7): 4Abu
  MISC_FEATURE (8)..(8): X is I, L or V
  MISC_FEATURE (9)..(9): X is T or S
  MISC_FEATURE (10)..(10): X is F or P
  MISC_FEATURE (11)..(11): X is K, R or H for basic amino acids
  MISC_FEATURE (12)..(12): X is Tor S
  MISC_FEATURE (13)..(13): X is F or P
XXXXXXXXXXXXX

SEQ ID NO: 110 - protein, 17 aa, Artificial
  peptide construct
  MISC_FEATURE (1)..(1): X is F, W or Y for aromatic amino acids
  MOD_RES (1)..(1): ACETYLATION
  MISC_FEATURE (2)..(2): X is N or Q for amidated amino acids
  MISC_FEATURE (3)..(3): X is N or Q for amidated amino acids
  MISC_FEATURE (4)..(4): X is I, L or V
  MISC_FEATURE (5)..(5): X is N or Q for amidated amino acids
  MISC_FEATURE (6)..(6): X is C or S
  MISC_FEATURE (7)..(7): X is D and E for acidic amino acids
  MISC_FEATURE (8)..(8): X is K, R or H for basic amino acids
  MISC_FEATURE (9)..(9): X is  A or G
  MISC_FEATURE (10)..(10): X is I,  L or V
  MISC_FEATURE (11)..(11): X is F or P
  MISC_FEATURE (12)..(12): X is N or Q for amidated amino acids
  MISC_FEATURE (13)..(13): X is D and E for acidic amino acids
  MISC_FEATURE (14)..(14): X is N or Q for amidated amino acids
  MISC_FEATURE (15)..(15): X is I, L or V
  MOD_RES (15)..(15): 4Abu
  MISC_FEATURE (16)..(16): X is D and E for acidic amino acids
  MISC_FEATURE (17)..(17): X is N or Q for amidated amino acids
XXXXXXXXXXXXXXXXX

SEQ ID NO: 111 - protein, 13 aa, Artificial
  peptide construct
  MISC_FEATURE (1)..(1): X is I, L or V
  MOD_RES (1)..(1): ACETYLATION
  MISC_FEATURE (2)..(2): X is F, W or Y for aromatic amino acids
  MISC_FEATURE (3)..(3): X is I, L or V
  MISC_FEATURE (4)..(4): X is K, R or H for basic amino acids
  MISC_FEATURE (5)..(5): X is K, R or H for basic amino acids
  MISC_FEATURE (6)..(6): X is I, L or V
  MISC_FEATURE (7)..(7): X is C or S
  MISC_FEATURE (8)..(8): X is N or Q for amidated amino acids
  MISC_FEATURE (9)..(9): X is I, L or V
  MOD_RES (9)..(9): 4Abu
  MOD_RES (9)..(9): GAMMA-CARBOXYGLUTAMIC ACID HYDROXYLATION
  MISC_FEATURE (10)..(10): X is I, L or V
  MISC_FEATURE (11)..(11): X is I, L or V
  MISC_FEATURE (12)..(12): X is K, R or H for basic amino acids
  MISC_FEATURE (13)..(13): X is  A or G
XXXXXXXXXXXXX

SEQ ID NO: 112 - protein, 15 aa, Artificial
  peptide construct
  MISC_FEATURE (1)..(1): X is M or Nle
  MOD_RES (1)..(1): ACETYLATION
  MISC_FEATURE (2)..(2): X is K, R or H for basic amino acids
  MISC_FEATURE (3)..(3): X is I, L or V
  MISC_FEATURE (4)..(4): X is T or S
  MISC_FEATURE (5)..(5): X is I, L or V
  MISC_FEATURE (6)..(6): X is A or G
  MISC_FEATURE (7)..(7): X is F, W or Y for aromatic amino acids
  MISC_FEATURE (8)..(8): X is N or Q for amidated amino acids
  MISC_FEATURE (9)..(9): X is N or Q for amidated amino acids
  MISC_FEATURE (10)..(10): X is F, W or Y for aromatic amino acids
  MISC_FEATURE (11)..(11): X is A or G
  MISC_FEATURE (12)..(12): X is F or P
  MISC_FEATURE (13)..(13): X is N or Q for amidated amino acids
  MISC_FEATURE (14)..(14): X is K, R or H for basic amino acids
  MISC_FEATURE (15)..(15): X is K, R or H for basic amino acids
XXXXXXXXXXXXXXX

SEQ ID NO: 113 - protein, 15 aa, Artificial
  peptide construct
  MISC_FEATURE (1)..(1): X is I, L or V
  MOD_RES (1)..(1): ACETYLATION
  MISC_FEATURE (2)..(2): X is A or G
  MISC_FEATURE (3)..(3): X is C or S
  MISC_FEATURE (4)..(4): X is K, R or H for basic amino acids
  MISC_FEATURE (5)..(5): X is K, R or H for basic amino acids
  MISC_FEATURE (6)..(6): X is I, L or V
  MOD_RES (6)..(6): 4Abu
  MISC_FEATURE (7)..(7): X is D and E for acidic amino acids
  MISC_FEATURE (8)..(8): X is A or G
  MISC_FEATURE (9)..(9): X is I, L or V
  MOD_RES (9)..(9): 4Abu
  MISC_FEATURE (10)..(10): X is I, L or V
  MISC_FEATURE (11)..(11): X is A or G
  MISC_FEATURE (12)..(12): X is A or G
  MISC_FEATURE (13)..(13): X is F, W or Y for aromatic amino acids
  MISC_FEATURE (14)..(14): X is N or Q for amidated amino acids
  MISC_FEATURE (15)..(15): X is N or Q for amidated amino acids
XXXXXXXXXXXXXXX

SEQ ID NO: 114 - protein, 19 aa, Artificial
  peptide construct
  MISC_FEATURE (1)..(1): X is I, L or V
  MOD_RES (1)..(1): 4Abu
  MOD_RES (1)..(1): GAMMA-CARBOXYGLUTAMIC ACID HYDROXYLATION
  MOD_RES (1)..(1): ACETYLATION
  MISC_FEATURE (2)..(2): X is D and E for acidic amino acids
  MISC_FEATURE (3)..(3): X is I, L or V
  MISC_FEATURE (4)..(4): X is F, W or Y for aromatic amino acids
  MISC_FEATURE (5)..(5): X is A or G
  MISC_FEATURE (6)..(6): X is C or S
  MISC_FEATURE (7)..(7): X is K, R or H for basic amino acids
  MISC_FEATURE (8)..(8): X is N or Q for amidated amino acids
  MISC_FEATURE (9)..(9): X is F, W or Y for aromatic amino acids
  MISC_FEATURE (10)..(10): X is K, R or H or basic amino acids
  MISC_FEATURE (11)..(11): X is I, L or V
  MISC_FEATURE (12)..(12): X is N or Q for amidated amino acids
  MISC_FEATURE (13)..(13): X is K, R or H for basic amino acids
  MISC_FEATURE (14)..(14): X is N or Q for amidated amino acids
  MISC_FEATURE (15)..(15): X is T or S
  MISC_FEATURE (16)..(16): X is I, L  or V
  MISC_FEATURE (17)..(17): X is A or G
  MISC_FEATURE (18)..(18): X is T or S
  MISC_FEATURE (19)..(19): X is A or G
XXXXXXXXXXXXXXXXXXX

SEQ ID NO: 115 - protein, 25 aa, Artificial
  peptide construct
  MISC_FEATURE (1)..(1): X is A or G
  MOD_RES (1)..(1): ACETYLATION
  MISC_FEATURE (2)..(2): X is I, L or V
  MISC_FEATURE (3)..(3): X is A or G
  MISC_FEATURE (4)..(4): X is A or G
  MISC_FEATURE (5)..(5): X is I, L or V
  MOD_RES (5)..(5): 4Abu
  MISC_FEATURE (6)..(6): X is I, L or V
  MISC_FEATURE (7)..(7): X is K, R or H for basic amino acids
  MISC_FEATURE (8)..(8): X is I, L or V
  MOD_RES (8)..(8): 4Abu
  MISC_FEATURE (9)..(9): X is I, L or V
  MISC_FEATURE (10)..(10): X is T or S
  MISC_FEATURE (11)..(11): X is T or S
  MISC_FEATURE (12)..(12): X is A or G
  MISC_FEATURE (13)..(13): X is F or P
  MISC_FEATURE (14)..(14): X is A or G
  MISC_FEATURE (15)..(15): X is I, L or V
  MOD_RES (15)..(15): 4Abu
  MISC_FEATURE (16)..(16): X is I, L or V
  MISC_FEATURE (17)..(17): X is C or S
  MISC_FEATURE (18)..(18): X is F, W or Y for basic amino acids
  MISC_FEATURE (19)..(19): X is I, L or V
  MISC_FEATURE (20)..(20): X is K, R or H for basic amino acids
  MISC_FEATURE (21)..(21): X is K, R or H for basic amino acids
  MISC_FEATURE (22)..(22): X is K, R or H for basic amino acids
  MISC_FEATURE (23)..(23): X is K, R or H for basic amino acids
  MISC_FEATURE (24)..(24): X is N or Q for amidated amino acids
  MISC_FEATURE (25)..(25): X is N or Q for amidated amino acids
XXXXXXXXXXXXXXXXXXXXXXXXX

SEQ ID NO: 116 - protein, 18 aa, Artificial
  peptide construct
  MISC_FEATURE (1)..(1): X is N or Q for amidated amino acids
  MOD_RES (1)..(1): ACETYLATION
  MISC_FEATURE (2)..(2): X is A or G
  MISC_FEATURE (3)..(3): X is N or Q for amidated amino acids
  MISC_FEATURE (4)..(4): X is D and E for acidic amino acids
  MOD_RES (4)..(4): 4Abu
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MOD_RES (9)..(9): 4Abu
  MISC_FEATURE (10)..(10): X is I, L or V
  MISC_FEATURE (11)..(11): X is  C or S
  MISC_FEATURE (12)..(12): X is T or S
  MISC_FEATURE (13)..(13): X is A or G
  MISC_FEATURE (14)..(14): X is I, L or V
  MOD_RES (14)..(14): 4Abu
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
XXXXXXXXXXXXXXXXXX

SEQ ID NO: 117 - protein, 18 aa, Artificial
  peptide construct
  MISC_FEATURE (1)..(1): X is D and E for acidic amino acids
  MOD_RES (1)..(1): ACETYLATION
  MISC_FEATURE (2)..(2): X is A or G
  MISC_FEATURE (3)..(3): X is N or Q for amidated amino acids
  MISC_FEATURE (4)..(4): X is D and E for acidic amino acids
  MOD_RES (4)..(4): 4Abu
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MOD_RES (9)..(9): 4Abu
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MOD_RES (14)..(14): 4Abu
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
XXXXXXXXXXXXXXXXXX

SEQ ID NO: 118 - protein, 17 aa, Artificial
  peptide construct
  MISC_FEATURE (1)..(1): X is I, L or V
  MOD_RES (1)..(1): ACETYLATION
  MOD_RES (1)..(1): 4Abu
  MISC_FEATURE (2)..(2): X is I, L or V
  MISC_FEATURE (3)..(3): X is F, W or Y for aromatic amino acids
  MISC_FEATURE (4)..(4): X is K, R or H for basic amino acids
  MISC_FEATURE (5)..(5): X is K, R or H for basic amino acids
  MISC_FEATURE (6)..(6): X is N or Q for amidated amino acids
  MISC_FEATURE (7)..(7): X is K, R or H for basic amino acids
  MISC_FEATURE (8)..(8): X is D and E for acidic amino acids
  MISC_FEATURE (9)..(9): X is K,  R or H for basic amino acids
  MISC_FEATURE (10)..(10): X is I, L or V
  MISC_FEATURE (11)..(11): X is A or G
  MISC_FEATURE (12)..(12): X is D and E for acidic amino acids
  MOD_RES (12)..(12): GAMMA-CARBOXYGLUTAMIC ACID HYDROXYLATION
  MISC_FEATURE (13)..(13): X is I, L or V
  MISC_FEATURE (14)..(14): X is D and E for acidic amino acids
  MISC_FEATURE (15)..(15): X is N or Q for amidated amino acids
  MISC_FEATURE (16)..(16): X is C or S
  MISC_FEATURE (17)..(17): X is D and E for acidic amino acids
XXXXXXXXXXXXXXXXX

SEQ ID NO: 119 - protein, 13 aa, Artificial
  peptide construct
  MISC_FEATURE (1)..(1): X is D and E for acidic amino acids
  MOD_RES (1)..(1): ACETYLATION
  MOD_RES (1)..(1): 4Abu
  MOD_RES (1)..(1): GAMMA-CARBOXYGLUTAMIC ACID HYDROXYLATION
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MOD_RES (9)..(9): 4Abu
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MOD_RES (12)..(12): 4Abu
  MISC_FEATURE (13)..(13): X is D and E for acidic amino acids
XXXXXXXXXXXXX

SEQ ID NO: 120 - protein, 11 aa, Artificial
  peptide construct
  MISC_FEATURE (1)..(1): X is F or P
  MOD_RES (1)..(1): ACETYLATION
  MISC_FEATURE (2)..(2): X is C or S
  MISC_FEATURE (3)..(3): X is T or S
  MISC_FEATURE (4)..(4): X is K, R or H for basic amino acids
  MISC_FEATURE (5)..(5): X is I, L or V
  MOD_RES (5)..(5): 4Abu
  MOD_RES (5)..(5): GAMMA-CARBOXYGLUTAMIC ACID HYDROXYLATION
  MISC_FEATURE (6)..(6): X is I, L or V
  MISC_FEATURE (7)..(7): X is I, L or V
  MISC_FEATURE (8)..(8): X is T or S
  MISC_FEATURE (9)..(9): X is K, R or H for basic amino acids
  MISC_FEATURE (10)..(10): X is T or S
  MISC_FEATURE (11)..(11): X is I, L or V
XXXXXXXXXXX

SEQ ID NO: 121 - protein, 15 aa, Artificial
  peptide construct
  MISC_FEATURE (1)..(1): X is D and E for acidic amino acids
  MOD_RES (1)..(1): ACETYLATION
  MISC_FEATURE (2)..(2): X is F, W or Y for aromatic amino acids
  MISC_FEATURE (3)..(3): X is I, L or V
  MISC_FEATURE (4)..(4): X is F or P
  MISC_FEATURE (5)..(5): X is K, R or H for basic amino acids
  MISC_FEATURE (6)..(6): X is F, W or Y for aromatic amino acids
  MISC_FEATURE (7)..(7): X is K, R or H for basic amino acids
  MISC_FEATURE (8)..(8): X is N or Q for amidated amino acids
  MISC_FEATURE (9)..(9): X is T or S
  MISC_FEATURE (10)..(10): X is  C or S
  MISC_FEATURE (11)..(11): X is I, L or V
  MISC_FEATURE (12)..(12): X is A  or G
  MISC_FEATURE (13)..(13): X is K, R or H for basic amino acids
  MISC_FEATURE (14)..(14): X is K, R or H for basic amino acids
  MISC_FEATURE (15)..(15): X is F or P
XXXXXXXXXXXXXXX

SEQ ID NO: 122 - protein, 9 aa, Artificial
  peptide construct
  MISC_FEATURE (1)..(1): X is A or G
  MOD_RES (1)..(1): ACETYLATION
  MISC_FEATURE (2)..(2): X is F, W or Y for aromatic amino acids
  MISC_FEATURE (3)..(3): X is M or Nle
  MISC_FEATURE (4)..(4): X is T or S
  MISC_FEATURE (5)..(5): X is M or Nle
  MISC_FEATURE (6)..(6): X is K, R or H for basic amino acids
  MISC_FEATURE (7)..(7): X is I, L or V
  MISC_FEATURE (8)..(8): X is K, R or H for basic amino acids
  MISC_FEATURE (9)..(9): X is N or Q for amidated amino acids
XXXXXXXXX

SEQ ID NO: 123 - protein, 31 aa, Artificial
  peptide construct
  MISC_FEATURE (1)..(1): X is D and E for acidic amino acids
  MOD_RES (1)..(1): ACETYLATION
  MISC_FEATURE (2)..(2): X is N or Q for amidated amino acids
  MISC_FEATURE (3)..(3): X is N or Q for amidated amino acids
  MISC_FEATURE (4)..(4): X is I, L or V
  MOD_RES (4)..(4): 4Abu
  MOD_RES (4)..(4): GAMMA-CARBOXYGLUTAMIC ACID HYDROXYLATION
  MISC_FEATURE (5)..(5): X is I, L or V
  MISC_FEATURE (6)..(6): X is D and E for acidic amino acids
  MISC_FEATURE (7)..(7): X is T or S
  MISC_FEATURE (8)..(8): X is C or S
  MISC_FEATURE (9)..(9): X is K, R or H for basic amino acids
  MISC_FEATURE (10)..(10): X is N or Q for amidated amino acids
  MISC_FEATURE (11)..(11): X is  D and E for acidic amino acids
  MISC_FEATURE (12)..(12): X is K, R or H for basic amino acids
  MISC_FEATURE (13)..(13): X is I, L or V
  MISC_FEATURE (14)..(14): X is K, R or H for basic amino acids
  MISC_FEATURE (15)..(15): X is N or Q for amidated amino acids
  MISC_FEATURE (16)..(16): X is K, R or H for basic amino acids
  MISC_FEATURE (17)..(17): X is K, R or H for basic amino acids
  MISC_FEATURE (18)..(18): X is  A or G
  MISC_FEATURE (19)..(19): X is N or Q for amidated amino acids
  MISC_FEATURE (20)..(20): X is A or G
  MISC_FEATURE (21)..(21): X is C or S
  MISC_FEATURE (22)..(22): X is C or S
  MISC_FEATURE (23)..(23): X is T or S
  MISC_FEATURE (24)..(24): X is K, R or H for basic amino acids
  MISC_FEATURE (25)..(25): X is F, W or Y for aromatic amino acids
  MISC_FEATURE (26)..(26): X is D and E for acidic amino acids
  MISC_FEATURE (27)..(27): X is A or G
  MISC_FEATURE (28)..(28): X is N or Q for amidated amino acids
  MISC_FEATURE (29)..(29): X is I,  L or V
  MISC_FEATURE (30)..(30): X is F or P
  MISC_FEATURE (31)..(31): X is C or S
XXXXXXXXXXXXXXXXXXXXXXXXXXXXXXX

SEQ ID NO: 124 - protein, 10 aa, Artificial
  peptide construct
  MISC_FEATURE (1)..(1): X is D and E for acidic amino acids
  MOD_RES (1)..(1): ACETYLATION
  MISC_FEATURE (2)..(2): X is N or Q for amidated amino acids
  MISC_FEATURE (3)..(3): X is T or S
  MISC_FEATURE (4)..(4): X is N or Q for amidated amino acids
  MISC_FEATURE (5)..(5): X is D and E for acidic amino acids
  MISC_FEATURE (6)..(6): X is T or S
  MISC_FEATURE (7)..(7): X is D and E for acidic amino acids
  MISC_FEATURE (8)..(8): X is A or G
  MISC_FEATURE (9)..(9): X is A or G
  MISC_FEATURE (10)..(10): X is C or S
XXXXXXXXXX

SEQ ID NO: 125 - protein, 9 aa, Artificial
  peptide construct
  MISC_FEATURE (1)..(1): X is I, L or V
  MOD_RES (1)..(1): ACETYLATION
  MISC_FEATURE (2)..(2): X is N or Q for amidated amino acids
  MISC_FEATURE (3)..(3): X is A or G
  MISC_FEATURE (4)..(4): X is D and E for acidic amino acids
  MOD_RES (4)..(4): 4Abu
  MISC_FEATURE (5)..(5): X is D and E for acidic amino acids
  MISC_FEATURE (6)..(6): X is C or S
  MISC_FEATURE (7)..(7): X is N or Q for amidated amino acids
  MISC_FEATURE (8)..(8): X is D and E for acidic amino acids
  MISC_FEATURE (9)..(9): X is K, R or H for basic amino acids
XXXXXXXXX

SEQ ID NO: 126 - protein, 16 aa, Artificial
  peptide construct
  MISC_FEATURE (1)..(1): X is D and E for acidic amino acids
  MOD_RES (1)..(1): ACETYLATION
  MOD_RES (1)..(1): 4Abu
  MOD_RES (1)..(1): GAMMA-CARBOXYGLUTAMIC ACID HYDROXYLATION
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MOD_RES (9)..(9): 4Abu
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MOD_RES (12)..(12): 4Abu
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
XXXXXXXXXXXXXXXX

SEQ ID NO: 127 - protein, 4 aa, Artificial
  peptide construct
  MISC_FEATURE (1)..(1): X is A or G
  MOD_RES (1)..(1): ACETYLATION
  MISC_FEATURE (2)..(2): X is A or G
  MISC_FEATURE (3)..(3): X is A or G
  MISC_FEATURE (4)..(4): X is C or S
XXXX

SEQ ID NO: 128 - protein, 5 aa, Artificial
  peptide construct
  MISC_FEATURE (1)..(1): X is A or G
  MOD_RES (1)..(1): ACETYLATION
  MISC_FEATURE (2)..(2): X is A or G
  MISC_FEATURE (3)..(3): X is A or G
  MISC_FEATURE (4)..(4): X is C or S
  MISC_FEATURE (5)..(5): X is C or S
XXXXX

SEQ ID NO: 129 - protein, 5 aa, Artificial
  peptide construct
  MISC_FEATURE (1)..(1): X is A or G
  MOD_RES (1)..(1): ACETYLATION
  MISC_FEATURE (2)..(2): X is A or G
  MISC_FEATURE (3)..(3): X is A or G
  MISC_FEATURE (4)..(4): X is A or G
  MISC_FEATURE (5)..(5): X is C or S
XXXXX

SEQ ID NO: 130 - protein, 5 aa, Artificial
  peptide construct
  MISC_FEATURE (1)..(1): X is A or G
  MOD_RES (1)..(1): ACETYLATION
  MISC_FEATURE (2)..(2): X is A or G
  MISC_FEATURE (3)..(3): X is A or G
  MISC_FEATURE (4)..(4): X is A or G
  MISC_FEATURE (5)..(5): X is C or S
XXXXX

SEQ ID NO: 131 - protein, 8 aa, Artificial
  peptide construct
  MISC_FEATURE (1)..(1): X is A or G
  MOD_RES (1)..(1): ACETYLATION
  MISC_FEATURE (2)..(2): X is A or G
  MISC_FEATURE (3)..(3): X is A or G
  MISC_FEATURE (4)..(4): X is C or S
  MISC_FEATURE (5)..(5): X is A or G
  MISC_FEATURE (6)..(6): X is A or G
  MISC_FEATURE (7)..(7): X is A or G
  MISC_FEATURE (8)..(8): X is C or S
XXXXXXXX

SEQ ID NO: 132 - protein, 8 aa, Artificial
  peptide construct
  MISC_FEATURE (1)..(1): X is I, L or V
  MOD_RES (1)..(1): ACETYLATION
  MISC_FEATURE (2)..(2): X is K, R or H for basic amino acids
  MISC_FEATURE (3)..(3): X is A or G
  MISC_FEATURE (4)..(4): X is A or G
  MISC_FEATURE (5)..(5): X is A or G
  MISC_FEATURE (6)..(6): X is A or G
  MISC_FEATURE (7)..(7): X is C or S
  MISC_FEATURE (8)..(8): X is C or S
XXXXXXXX

SEQ ID NO: 133 - protein, 12 aa, Artificial
  peptide construct
  MISC_FEATURE (1)..(1): X is A or G
  MOD_RES (1)..(1): ACETYLATION
  MISC_FEATURE (2)..(2): X is A or G
  MISC_FEATURE (3)..(3): X is A or G
  MISC_FEATURE (4)..(4): X is C or S
  MISC_FEATURE (5)..(5): X is A or G
  MISC_FEATURE (6)..(6): X is T or S
  MISC_FEATURE (7)..(7): X is A or G
  MISC_FEATURE (8)..(8): X is C or S
  MISC_FEATURE (9)..(9): X is A or G
  MISC_FEATURE (10)..(10): X is C or S
  MISC_FEATURE (11)..(11): X is A or G
  MISC_FEATURE (12)..(12): X is C or S
XXXXXXXXXXXX

SEQ ID NO: 134 - protein, 58 aa, Artificial
  Completely synthesized peptide construct
DGQEEKAGVVSTGLIGGGDAEFRHDSGYEVHHQKLVFFAEDVGSNKGAIIGLMVGGVV

SEQ ID NO: 135 - protein, 58 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is D and E for acidic amino acids
  MISC_FEATURE (20)..(20): X is A or G
  MISC_FEATURE (21)..(21): X is D and E for acidic amino acids
  MISC_FEATURE (22)..(22): X is F, W or Y for aromatic amino acids
  MISC_FEATURE (23)..(23): X is K, R or H for basic amino acids
  MISC_FEATURE (24)..(24): X is K, R or H for basic amino acids
  MISC_FEATURE (25)..(25): X is D and E for acidic amino acids
  MISC_FEATURE (26)..(26): X is T or S
  MISC_FEATURE (27)..(27): X is A or G
  MISC_FEATURE (28)..(28): X is F, W or Y for aromatic amino acids
  MISC_FEATURE (29)..(29): X is D and E for acidic amino acids
  MISC_FEATURE (30)..(30): X is I, L or V
  MISC_FEATURE (31)..(31): X is K, R or H for basic amino acids
  MISC_FEATURE (32)..(32): X is K, R or H for basic amino acids
  MISC_FEATURE (33)..(33): X is N or Q for amidated amino acids
  MISC_FEATURE (34)..(34): X is K, R or H for basic amino acids
  MISC_FEATURE (35)..(35): X is I, L  or V
  MISC_FEATURE (36)..(36): X is I, L  or V
  MISC_FEATURE (37)..(37): X is F, W or Y for aromatic amino acids
  MISC_FEATURE (38)..(38): X is F, W or Y for aromatic amino acids
  MISC_FEATURE (39)..(39): X is A or G
  MISC_FEATURE (40)..(40): X is D and E for acidic amino acids
  MISC_FEATURE (41)..(41): X is D and E for acidic amino acids
  MISC_FEATURE (42)..(42): X is I, L or V
  MISC_FEATURE (43)..(43): X is A or G
  MISC_FEATURE (44)..(44): X is C or S
  MISC_FEATURE (45)..(45): X is N or Q for amidated amino acids
  MISC_FEATURE (46)..(46): X is K, R or H for basic amino acids
  MISC_FEATURE (47)..(47): X is A or G
  MISC_FEATURE (48)..(48): X is A or G
  MISC_FEATURE (49)..(49): X is I, L or V
  MISC_FEATURE (50)..(50): X is I, L or V
  MISC_FEATURE (51)..(51): X is A or G
  MISC_FEATURE (52)..(52): X is I, L or V
  MISC_FEATURE (53)..(53): X is M or Nle
  MISC_FEATURE (54)..(54): X is I, L or V
  MISC_FEATURE (55)..(55): X is A or G
  MISC_FEATURE (56)..(56): X is A or G
  MISC_FEATURE (57)..(57): X is I, L or V
  MISC_FEATURE (58)..(58): X is I, L or V
XXXXXXXXXXXXXXXXXXXXXXXXXXXXXXXXXXXXXXXXXXXXXXXXXXXXXXXXXX

SEQ ID NO: 136 - protein, 46 aa, Artificial
  Completely synthesized peptide construct
DGQEEKAGVVSTGLIGGGDAEFRHDSGYEVHHQKLVFFAENVGSNK

SEQ ID NO: 137 - protein, 46 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is D and E for acidic amino acids
  MISC_FEATURE (20)..(20): X is A or G
  MISC_FEATURE (21)..(21): X is D and E for acidic amino acids
  MISC_FEATURE (22)..(22): X is F, W or Y for aromatic amino acids
  MISC_FEATURE (23)..(23): X is K, R or H for basic amino acids
  MISC_FEATURE (24)..(24): X is K, R or H for basic amino acids
  MISC_FEATURE (25)..(25): X is D and E for basic amino acids
  MISC_FEATURE (26)..(26): X is T or S
  MISC_FEATURE (27)..(27): X is A or G
  MISC_FEATURE (28)..(28): X is F, W or Y for aromatic amino acids
  MISC_FEATURE (29)..(29): X is D and E for acidic amino acids
  MISC_FEATURE (30)..(30): X is I, L or V
  MISC_FEATURE (31)..(31): X is K, R or H for basic amino acids
  MISC_FEATURE (32)..(32): X is K, R or H for basic amino acids
  MISC_FEATURE (33)..(33): X is N or Q for amidated amino acids
  MISC_FEATURE (34)..(34): X is K, R or H for basic amino acids
  MISC_FEATURE (35)..(35): X is I, L or V
  MISC_FEATURE (36)..(36): X is I, L or V
  MISC_FEATURE (37)..(37): X is F, W or Y for aromatic amino acids
  MISC_FEATURE (38)..(38): X is F, W or Y for aromatic amino acids
  MISC_FEATURE (39)..(39): X is A or G
  MISC_FEATURE (40)..(40): X is D and E for acidic amino acids
  MISC_FEATURE (41)..(41): X is D and E for acidic amino acids
  MISC_FEATURE (42)..(42): X is I, L or V
  MISC_FEATURE (43)..(43): X is A or G
  MISC_FEATURE (44)..(44): X is C or S
  MISC_FEATURE (45)..(45): X is N or Q for amidated amino acids
  MISC_FEATURE (46)..(46): X is K, R or H for basic amino acids
XXXXXXXXXXXXXXXXXXXXXXXXXXXXXXXXXXXXXXXXXXXXXX

SEQ ID NO: 138 - protein, 48 aa, Artificial
  Completely synthesized peptide construct
DGQEEKAGVVSTGLIGGGDAEFRHDSGYEVHHQKLVFFAENVGSNKAI

SEQ ID NO: 139 - protein, 48 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is D and E for acidic amino acids
  MISC_FEATURE (20)..(20): X is A or G
  MISC_FEATURE (21)..(21): X is D and E for acidic amino acids
  MISC_FEATURE (22)..(22): X is F, W or Y for aromatic amino acids
  MISC_FEATURE (23)..(23): X is K, R or H for basic amino acids
  MISC_FEATURE (24)..(24): X is K, R or H for basic amino acids
  MISC_FEATURE (25)..(25): X is D and E for acidic amino acids
  MISC_FEATURE (26)..(26): X is T or S
  MISC_FEATURE (27)..(27): X is A or G
  MISC_FEATURE (28)..(28): X is F, W or Y for aromatic amino acids
  MISC_FEATURE (29)..(29): X is D and E for acidic amino acids
  MISC_FEATURE (30)..(30): X is I, L or V
  MISC_FEATURE (31)..(31): X is K, R or H for basic amino acids
  MISC_FEATURE (32)..(32): X is K, R or H for basic amino acids
  MISC_FEATURE (33)..(33): X is N or Q for amidated amino acids
  MISC_FEATURE (34)..(34): X is K, R or H for basic amino acids
  MISC_FEATURE (35)..(35): X is I, L or V
  MISC_FEATURE (36)..(36): X is I, L or V
  MISC_FEATURE (37)..(37): X is F, W or Y for aromatic amino acids
  MISC_FEATURE (38)..(38): X is F, W or Y for aromatic amino acids
  MISC_FEATURE (39)..(39): X is A or G
  MISC_FEATURE (40)..(40): X is Dand E for acidic amino acids
  MISC_FEATURE (41)..(41): X is Dand E for acidic amino acids
  MISC_FEATURE (42)..(42): X is I, L or V
  MISC_FEATURE (43)..(43): X is A or G
  MISC_FEATURE (44)..(44): X is C or S
  MISC_FEATURE (45)..(45): X is N or Q for amidated amino acids
  MISC_FEATURE (46)..(46): X is K, R or H for basic amino acids
  MISC_FEATURE (47)..(47): X is A or G
  MISC_FEATURE (48)..(48): X is I, L or V
XXXXXXXXXXXXXXXXXXXXXXXXXXXXXXXXXXXXXXXXXXXXXXXX

SEQ ID NO: 140 - protein, 29 aa, Artificial
  Completely synthesized peptide construct
DGQEEKAGVVSTGLIGGGDAEFRHDSGYE

SEQ ID NO: 141 - protein, 29 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is D and E for acidic amino acids
  MISC_FEATURE (20)..(20): X is A or G
  MISC_FEATURE (21)..(21): X is D and E for acidic amino acids
  MISC_FEATURE (22)..(22): X is F, W or Y for aromatic amino acids
  MISC_FEATURE (23)..(23): X is K, R or H for basic amino acids
  MISC_FEATURE (24)..(24): X is K, R or H for basic amino acids
  MISC_FEATURE (25)..(25): X is D and E for acidic amino acids
  MISC_FEATURE (26)..(26): X is  T or S
  MISC_FEATURE (27)..(27): X is A or G
  MISC_FEATURE (28)..(28): X is F, W or Y for aromatic amino acids
  MISC_FEATURE (29)..(29): X is D and E for acidic amino acids
XXXXXXXXXXXXXXXXXXXXXXXXXXXXX

SEQ ID NO: 142 - protein, 25 aa, Artificial
  Completely synthesized peptide construct
DGQEEKAGVVSTGLIGGGENVGSNK

SEQ ID NO: 143 - protein, 25 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is D and E for acidic amino acids
  MISC_FEATURE (20)..(20): X is D and E for acidic amino acids
  MISC_FEATURE (21)..(21): X is I, L or V
  MISC_FEATURE (22)..(22): X is A or G
  MISC_FEATURE (23)..(23): X is C or S
  MISC_FEATURE (24)..(24): X is N or Q for amidated amino acids
  MISC_FEATURE (25)..(25): X is K, R or H for basic amino acids
XXXXXXXXXXXXXXXXXXXXXXXXX

SEQ ID NO: 144 - protein, 30 aa, Artificial
  Completely synthesized peptide construct
DGQEEKAGVVSTGLIGGGDAEFRHDSGYEV

SEQ ID NO: 145 - protein, 30 aa, Artificial; identical to SEQ ID NO: 56
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is D and E for acidic amino acids
  MISC_FEATURE (20)..(20): X is A or G
  MISC_FEATURE (21)..(21): X is D and E for acidic amino acids
  MISC_FEATURE (22)..(22): X is F, W or Y for aromatic amino acids
  MISC_FEATURE (23)..(23): X is K, R or H for basic amino acids
  MISC_FEATURE (24)..(24): X is K, R or H for basic amino acids
  MISC_FEATURE (25)..(25): X is D and E for acidic amino acids
  MISC_FEATURE (26)..(26): X is T or S
  MISC_FEATURE (27)..(27): X is A or G
  MISC_FEATURE (28)..(28): X is F, W or Y for aromatic amino acids
  MISC_FEATURE (29)..(29): X is D and E for acidic amino acids
  MISC_FEATURE (30)..(30): X is I, L or V

SEQ ID NO: 146 - protein, 28 aa, Artificial
  Completely synthesized peptide construct
DGQEEKAGVVSTGLIGGGDAEFRHDSGY

SEQ ID NO: 147 - protein, 28 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for amidated amino acids
  MISC_FEATURE (5)..(5): X is D and E for amidated amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is D and E for acidic amino acids
  MISC_FEATURE (20)..(20): X is A or G
  MISC_FEATURE (21)..(21): X is D and E for acidic amino acids
  MISC_FEATURE (22)..(22): X is F, W or Y for aromatic amino acids
  MISC_FEATURE (23)..(23): X is K, R or H for basic amino acids
  MISC_FEATURE (24)..(24): X is K, R or H for basic amino acids
  MISC_FEATURE (25)..(25): X is D and E for acidic amino acids
  MISC_FEATURE (26)..(26): X is T or S
  MISC_FEATURE (27)..(27): X is A or G
  MISC_FEATURE (28)..(28): X is F, W or Y for aromatic amino acids
XXXXXXXXXXXXXXXXXXXXXXXXXXXX

SEQ ID NO: 148 - protein, 22 aa, Artificial
  Completely synthesized peptide construct
DGQEEKAGVVSTGLIGGGEFRH

SEQ ID NO: 149 - protein, 22 aa, Artificial
  peptide construct
  MISC_FEATURE (1)..(1): X is D and E for acidic amino acids
  MISC_FEATURE (2)..(2): X is  A or G
  MISC_FEATURE (3)..(3): X is N or Q for aromatic amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is D and E for acidic amino acids
  MISC_FEATURE (20)..(20): X is F or P
  MISC_FEATURE (21)..(21): X is K, R or H for basic amino acids
  MISC_FEATURE (22)..(22): X is K, R or H for basic amino acids
XXXXXXXXXXXXXXXXXXXXXX

SEQ ID NO: 150 - protein, 36 aa, Artificial
  Completely synthesized peptide construct
DGQEEKAGVVSTGLIGGGSAFDVLSFTAEEKAGVYK

SEQ ID NO: 151 - protein, 37 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is D and E for acidic amino acids
  MISC_FEATURE (20)..(20): X is C or S
  MISC_FEATURE (21)..(21): X is A or G
  MISC_FEATURE (22)..(22): X is F, W or Y for aromatic amino acids
  MISC_FEATURE (23)..(23): X is D and E for acidic amino acids
  MISC_FEATURE (24)..(24): X is I, L or V
  MISC_FEATURE (25)..(25): X is I, L or V
  MISC_FEATURE (26)..(26): X is C or S
  MISC_FEATURE (27)..(27): X is F, W or Y for aromatic amino acids
  MISC_FEATURE (28)..(28): X is T or S
  MISC_FEATURE (29)..(29): X is A or G
  MISC_FEATURE (30)..(30): X is D and E for acidic amino acids
  MISC_FEATURE (31)..(31): X is D and E for acidic amino acids
  MISC_FEATURE (32)..(32): X is K, R or H for basic amino acids
  MISC_FEATURE (33)..(33): X is A or G
  MISC_FEATURE (34)..(34): X is A or G
  MISC_FEATURE (35)..(35): X is I, L or V
  MISC_FEATURE (36)..(36): X is F, W or Y for aromatic amino acids
  MISC_FEATURE (37)..(37): X is K, R or H for basic amino acids
XXXXXXXXXXXXXXXXXXXXXXXXXXXXXXXXXXXXX

SEQ ID NO: 152 - protein, 18 aa, Artificial
  Completely synthesized peptide construct
DGQEEKAGVVSTGLIGGG

SEQ ID NO: 153 - protein, 32 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MOD_RES (19)..(19): ACETYLATION
  MISC_FEATURE (19)..(19): X is C or S
  MISC_FEATURE (20)..(20): X is I, L or V
  MISC_FEATURE (21)..(21): X is K, R or H for basic amino acids
  MISC_FEATURE (22)..(22): X is I, L or V
  MISC_FEATURE (23)..(23): X is M or Nle
  MISC_FEATURE (24)..(24): X is A or G
  MISC_FEATURE (25)..(25): X is T or S
  MISC_FEATURE (26)..(26): X is I, L or V
  MISC_FEATURE (27)..(27): X is F or P
  MISC_FEATURE (28)..(28): X is C or S
  MISC_FEATURE (29)..(29): X is T or S
  MISC_FEATURE (30)..(30): X is F, W or Y for aromatic amino acids
  MISC_FEATURE (31)..(31): X is A or G
  MISC_FEATURE (32)..(32): X is C or S
XXXXXXXXXXXXXXXXXXXXXXXXXXXXXXXX

SEQ ID NO: 154 - protein, 32 aa, Artificial; identical to SEQ ID NO: 153
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is C or S
  MISC_FEATURE (20)..(20): X is I, L or V
  MISC_FEATURE (21)..(21): X is K, R or H for basic amino acids
  MISC_FEATURE (22)..(22): X is I, L or V
  MISC_FEATURE (23)..(23): X is M or Nle
  MISC_FEATURE (24)..(24): X is A or G
  MISC_FEATURE (25)..(25): X is T or S
  MISC_FEATURE (26)..(26): X is I, L or V
  MISC_FEATURE (27)..(27): X is F or P
  MISC_FEATURE (28)..(28): X is C or S
  MISC_FEATURE (29)..(29): X is C or S
  MISC_FEATURE (30)..(30): X is F, W or Y for aromatic amino acids
  MISC_FEATURE (31)..(31): X is A or G
  MISC_FEATURE (32)..(32): X is T or S

SEQ ID NO: 155 - protein, 29 aa, Artificial
  Completely synthesized peptide construct
DGQEEKAGVVSTGLIGGGNITEIADLTQK

SEQ ID NO: 156 - protein, 29 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is N or Q for amidated amino acids
  MISC_FEATURE (20)..(20): X is I, L or V
  MISC_FEATURE (21)..(21): X is T or S
  MISC_FEATURE (22)..(22): X is D and E for acidic amino acids
  MISC_FEATURE (23)..(23): X is I, L or V
  MISC_FEATURE (24)..(24): X is A or G
  MISC_FEATURE (25)..(25): X is D and E for acidic amino acids
  MISC_FEATURE (26)..(26): X is I, L or V
  MISC_FEATURE (27)..(27): X is T or S
  MISC_FEATURE (28)..(28): X is N or Q for amidated amino acids
  MISC_FEATURE (29)..(29): X is K, R or H for basic amino acids
XXXXXXXXXXXXXXXXXXXXXXXXXXXXX

SEQ ID NO: 157 - protein, 58 aa, Artificial
  Completely synthesized peptide construct
DGQEEKAGVVSTGLIGGGNMYAMMIARFKMFPEVKEKGMAALPRLIAFTSEHSHFSLK

SEQ ID NO: 158 - protein, 58 aa, Artificial; identical to SEQ ID NO: 135
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is N or Q for amidated amino acids
  MISC_FEATURE (20)..(20): X is M or Nle
  MISC_FEATURE (21)..(21): X is F, W or Y for aromatic amino acids
  MISC_FEATURE (22)..(22): X is A or G
  MISC_FEATURE (23)..(23): X is M or Nle
  MISC_FEATURE (24)..(24): X is M or Nle
  MISC_FEATURE (25)..(25): X is I, L or V
  MISC_FEATURE (26)..(26): X is A or G
  MISC_FEATURE (27)..(27): X is K, R or H for basic amino acids
  MISC_FEATURE (28)..(28): X is F, W or Y for aromatic amino acids
  MISC_FEATURE (29)..(29): X is K, R or H for basic amino acids
  MISC_FEATURE (30)..(30): X is M or Nle
  MISC_FEATURE (31)..(31): X is F, W or Y for aromatic amino acids
  MISC_FEATURE (32)..(32): X is F or P
  MISC_FEATURE (33)..(33): X is D and E for acidic amino acids
  MISC_FEATURE (34)..(34): X is I, L or V
  MISC_FEATURE (35)..(35): X is K, R or H for basic amino acids
  MISC_FEATURE (36)..(36): X is D and E for acidic amino acids
  MISC_FEATURE (37)..(37): X is K, R or H for basic amino acids
  MISC_FEATURE (38)..(38): X is A or G
  MISC_FEATURE (39)..(39): X is M or Nle
  MISC_FEATURE (40)..(40): X is A or G
  MISC_FEATURE (41)..(41): X is A or G
  MISC_FEATURE (42)..(42): X is I, L or V
  MISC_FEATURE (43)..(43): X is F or P
  MISC_FEATURE (44)..(44): X is K, R or H for basic amino acids
  MISC_FEATURE (45)..(45): X is I, L or V
  MISC_FEATURE (46)..(46): X is I, L or V
  MISC_FEATURE (47)..(47): X is A or G
  MISC_FEATURE (48)..(48): X is F, W or Y for aromatic amino acids
  MISC_FEATURE (49)..(49): X is T or S
  MISC_FEATURE (50)..(50): X is C or S
  MISC_FEATURE (51)..(51): X is D and E for acidic amino acids
  MISC_FEATURE (52)..(52): X is K, R or H for basic amino acids
  MISC_FEATURE (53)..(53): X is C or S
  MISC_FEATURE (54)..(54): X is K, R or H for basic amino acids
  MISC_FEATURE (55)..(55): X is F, W or Y for aromatic amino acids
  MISC_FEATURE (56)..(56): X is C or S
  MISC_FEATURE (57)..(57): X is I, L or V
  MISC_FEATURE (58)..(58): X is K, R or H for basic amino acids

SEQ ID NO: 159 - protein, 51 aa, Artificial
  Completely synthesized peptide construct
DGQEEKAGVVSTGLIGGGIARFKMFPEVKEKGMAALPRLIATSEHSHFSLK

SEQ ID NO: 160 - protein, 52 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for aromatic amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is I, L or V
  MISC_FEATURE (20)..(20): X is A or G
  MISC_FEATURE (21)..(21): X is K, R or H for basic amino acids
  MISC_FEATURE (22)..(22): X is F, W or Y for aromatic amino acids
  MISC_FEATURE (23)..(23): X is K, R or H for basic amino acids
  MISC_FEATURE (24)..(24): X is M or Nle
  MISC_FEATURE (25)..(25): X is F, W or Y for aromatic amino acids
  MISC_FEATURE (26)..(26): X is F or P
  MISC_FEATURE (27)..(27): X is D and E for acidic amino acids
  MISC_FEATURE (28)..(28): X is I, L or V
  MISC_FEATURE (29)..(29): X is K, R or H basic amino acids
  MISC_FEATURE (30)..(30): X is D and E for acidic amino acids
  MISC_FEATURE (31)..(31): X is D and E for acidic amino acids
  MISC_FEATURE (32)..(32): X is A or G
  MISC_FEATURE (33)..(33): X is M or Nle
  MISC_FEATURE (34)..(34): X is  A or G
  MISC_FEATURE (35)..(35): X is  A or G
  MISC_FEATURE (36)..(36): X is I, L or V
  MISC_FEATURE (37)..(37): X is F or P
  MISC_FEATURE (38)..(38): X is K, R or H for basic amino acids
  MISC_FEATURE (39)..(39): X is I, L or V
  MISC_FEATURE (40)..(40): X is I, L or V
  MISC_FEATURE (41)..(41): X is A or G
  MISC_FEATURE (42)..(42): X is F, W or Y for aromatic amino acids
  MISC_FEATURE (43)..(43): X is T or S
  MISC_FEATURE (44)..(44): X is C or S
  MISC_FEATURE (45)..(45): X is D and  E for acidic amino acids
  MISC_FEATURE (46)..(46): X is K, R or H basic amino acids
  MISC_FEATURE (47)..(47): X is C or S
  MISC_FEATURE (48)..(48): X is K, R or H basic amino acids
  MISC_FEATURE (49)..(49): X is F, W or Y for aromatic amino acids
  MISC_FEATURE (50)..(50): X is C or S
  MISC_FEATURE (51)..(51): X is I, L or V
  MISC_FEATURE (52)..(52): X is K, R or H basic amino acids
XXXXXXXXXXXXXXXXXXXXXXXXXXXXXXXXXXXXXXXXXXXXXXXXXXXX

SEQ ID NO: 161 - protein, 38 aa, Artificial
  Completely synthesized peptide construct
DGQEEKAGVVSTGLIGGGSRLSKVAPVIKARMMEYGTT

SEQ ID NO: 162 - protein, 38 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A  or G
  MISC_FEATURE (17)..(17): X is A  or G
  MISC_FEATURE (18)..(18): X is A  or G
  MISC_FEATURE (19)..(19): X is C or S
  MISC_FEATURE (20)..(20): X is K, R or H for basic amino acids
  MISC_FEATURE (21)..(21): X is I, L or V
  MISC_FEATURE (22)..(22): X is C or S
  MISC_FEATURE (23)..(23): X is K, R or H for basic amino acids
  MISC_FEATURE (24)..(24): X is I, L or V
  MISC_FEATURE (25)..(25): X is A or G
  MISC_FEATURE (26)..(26): X is F or P
  MISC_FEATURE (27)..(27): X is I, L or V
  MISC_FEATURE (28)..(28): X is I, L or V
  MISC_FEATURE (29)..(29): X is K, R or H for basic amino acids
  MISC_FEATURE (30)..(30): X is A or G
  MISC_FEATURE (31)..(31): X is K, R or H for basic amino acids
  MISC_FEATURE (32)..(32): X is M or Nle
  MISC_FEATURE (33)..(33): X is M or Nle
  MISC_FEATURE (34)..(34): X is D and E for acidic amino acids
  MISC_FEATURE (35)..(35): X is F, W or Y for aromatic amino acids
  MISC_FEATURE (36)..(36): X is A or G
  MISC_FEATURE (37)..(37): X is T or S
  MISC_FEATURE (38)..(38): X is T or S
XXXXXXXXXXXXXXXXXXXXXXXXXXXXXXXXXXXXXX

SEQ ID NO: 163 - protein, 37 aa, Artificial
  Completely synthesized peptide construct
DGQEEKAGVVSTGLIGGGIPPSLRYLEDEERMSRLSK

SEQ ID NO: 164 - protein, 36 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for aromatic amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is I, L or V
  MISC_FEATURE (20)..(20): X is F or P
  MISC_FEATURE (21)..(21): X is F or P
  MISC_FEATURE (22)..(22): X is C or S
  MISC_FEATURE (23)..(23): X is I, L or V
  MISC_FEATURE (24)..(24): X is K, R or H for basic amino acids
  MISC_FEATURE (25)..(25): X is F, W or Y for aromatic amino acids
  MISC_FEATURE (26)..(26): X is D and E for acidic amino acids
  MISC_FEATURE (27)..(27): X is D and E for acidic amino acids
  MISC_FEATURE (28)..(28): X is D and E for acidic amino acids
  MISC_FEATURE (29)..(29): X is D and E for acidic amino acids
  MISC_FEATURE (30)..(30): X is K, R or H for basic amino acids
  MISC_FEATURE (31)..(31): X is M or Nle
  MISC_FEATURE (32)..(32): X is  C or S
  MISC_FEATURE (33)..(33): X is K, R or H for basic amino acids
  MISC_FEATURE (34)..(34): X is I, L or V
  MISC_FEATURE (35)..(35): X is C or S
  MISC_FEATURE (36)..(36): X is K, R or H for basic amino acids
XXXXXXXXXXXXXXXXXXXXXXXXXXXXXXXXXXXX

SEQ ID NO: 165 - protein, 38 aa, Artificial
  Completely synthesized peptide construct
DGQEEKAGVVSTGLIGGGNTNMFTYEIAPVFVLLEYVT

SEQ ID NO: 166 - protein, 38 aa, Artificial; identical to SEQ ID NO: 162
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is  A or G
  MISC_FEATURE (8)..(8): X is  A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is N or Q for amidated amino acids
  MISC_FEATURE (20)..(20): X is T or S
  MISC_FEATURE (21)..(21): X is N or Q for aromatic amino acids
  MISC_FEATURE (22)..(22): X is M or Nle
  MISC_FEATURE (23)..(23): X is F, W or Y for aromatic amino acids
  MISC_FEATURE (24)..(24): X is T or S
  MISC_FEATURE (25)..(25): X is F, W or Y for aromatic amino acids
  MISC_FEATURE (26)..(26): X is D and E for acidic amino acids
  MISC_FEATURE (27)..(27): X is I, L or V
  MISC_FEATURE (28)..(28): X is A or G
  MISC_FEATURE (29)..(29): X is F or P
  MISC_FEATURE (30)..(30): X is I, L or V
  MISC_FEATURE (31)..(31): X is F, W or Y for aromatic amino acids
  MISC_FEATURE (32)..(32): X is I, L or V
  MISC_FEATURE (33)..(33): X is I, L or V
  MISC_FEATURE (34)..(34): X is I, L or V
  MISC_FEATURE (35)..(35): X is D and E for acidic amino acids
  MISC_FEATURE (36)..(36): X is F, W or Y for aromatic amion acids
  MISC_FEATURE (37)..(37): X is I, L or V
  MISC_FEATURE (38)..(38): X is T or S

SEQ ID NO: 167 - protein, 33 aa, Artificial
  Completely synthesized peptide construct
DGQEEKAGVVSTGLIGGGFKADEKKFWGKYLYE

SEQ ID NO: 168 - protein, 33 aa, Artificial; identical to SEQ ID NO: 97
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is F, W or Y for aromatic amino acids
  MISC_FEATURE (20)..(20): X is K, R or H for basic amino acids
  MISC_FEATURE (21)..(21): X is  A or G
  MISC_FEATURE (22)..(22): X is D and E for acidic amino acids
  MISC_FEATURE (23)..(23): X is D and E for acidic amino acids
  MISC_FEATURE (24)..(24): X is K, R or H for basic amino acids
  MISC_FEATURE (25)..(25): X is K, R or H for basic amino acids
  MISC_FEATURE (26)..(26): X is F, W or Y for aromatic amino acids
  MISC_FEATURE (27)..(27): X is F, W or Y for aromatic amino acids
  MISC_FEATURE (28)..(28): X is A or G
  MISC_FEATURE (29)..(29): X is K, R or H for basic amino acids
  MISC_FEATURE (30)..(30): X is F, W or Y for aromatic amino acids
  MISC_FEATURE (31)..(31): X is I, L or V
  MISC_FEATURE (32)..(32): X is F, W or Y for aromatic amino acids
  MISC_FEATURE (33)..(33): X is D and E for acidic amino acids

SEQ ID NO: 169 - protein, 33 aa, Artificial
  Completely synthesized peptide construct
DGQEEKAGVVSTGLIGGGSHLVEALYLVCGERG

SEQ ID NO: 170 - protein, 32 aa, Artificial; identical to SEQ ID NO: 153
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is C or S
  MISC_FEATURE (20)..(20): X is K, R or H for basic amino acids
  MISC_FEATURE (21)..(21): X is I, L or V
  MISC_FEATURE (22)..(22): X is I, L or V
  MISC_FEATURE (23)..(23): X is D and E for acidic amino acids
  MISC_FEATURE (24)..(24): X is A or G
  MISC_FEATURE (25)..(25): X is I, L or V
  MISC_FEATURE (26)..(26): X is F, W or Y for aromatic amino acids
  MISC_FEATURE (27)..(27): X is I, L or V
  MISC_FEATURE (28)..(28): X is C or S
  MISC_FEATURE (29)..(29): X is A or G
  MISC_FEATURE (30)..(30): X is D and E for acidic amino acids
  MISC_FEATURE (31)..(31): X is K, R or H for basic amino acids
  MISC_FEATURE (32)..(32): X is A or G

SEQ ID NO: 171 - protein, 42 aa, Artificial
  Completely synthesized peptide construct
DGQEEKAGVVSTGLIGGGVLGGGCALLRCIPALDSLTPANED

SEQ ID NO: 172 - protein, 42 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is I, L or V
  MISC_FEATURE (20)..(20): X is I, L or V
  MISC_FEATURE (21)..(21): X is A or G
  MISC_FEATURE (22)..(22): X is A or G
  MISC_FEATURE (23)..(23): X is A or G
  MISC_FEATURE (24)..(24): X is C or S
  MISC_FEATURE (25)..(25): X is A or G
  MISC_FEATURE (26)..(26): X is I, L or V
  MISC_FEATURE (27)..(27): X is I, L or V
  MISC_FEATURE (28)..(28): X is K, R or H for basic amino acids
  MISC_FEATURE (29)..(29): X is C  or S
  MISC_FEATURE (30)..(30): X is I, L or V
  MISC_FEATURE (31)..(31): X is F or P
  MISC_FEATURE (32)..(32): X is A or G
  MISC_FEATURE (33)..(33): X is I, L or V
  MISC_FEATURE (34)..(34): X is D and E for acidic amino acids
  MISC_FEATURE (35)..(35): X is C or S
  MISC_FEATURE (36)..(36): X is I, L or V
  MISC_FEATURE (37)..(37): X is T or S
  MISC_FEATURE (38)..(38): X is F or P
  MISC_FEATURE (39)..(39): X is A or G
  MISC_FEATURE (40)..(40): X is N or Q for amidated amino acids
  MISC_FEATURE (41)..(41): X is D and E for acidic amino acids
  MISC_FEATURE (42)..(42): X is D and E for acidic amino acids
XXXXXXXXXXXXXXXXXXXXXXXXXXXXXXXXXXXXXXXXXX

SEQ ID NO: 173 - protein, 46 aa, Artificial
  Completely synthesized peptide construct
DGQEEKAGVVSTGLIGGGEACVTSWLWSGEGAVFYRVDLHFINLGT

SEQ ID NO: 174 - protein, 46 aa, Artificial; identical to SEQ ID NO: 137
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is D and E for acidic amino acids
  MISC_FEATURE (20)..(20): X is A or G
  MISC_FEATURE (21)..(21): X is C or S
  MISC_FEATURE (22)..(22): X is I, L or V
  MISC_FEATURE (23)..(23): X is T or S
  MISC_FEATURE (24)..(24): X is C or S
  MISC_FEATURE (25)..(25): X is F, W or Y for aromatic amino acids
  MISC_FEATURE (26)..(26): X is I, L or V
  MISC_FEATURE (27)..(27): X is F, W or Y for aromatic amino acids
  MISC_FEATURE (28)..(28): X is C or S
  MISC_FEATURE (29)..(29): X is A or G
  MISC_FEATURE (30)..(30): X is D and E for acidic amino acids
  MISC_FEATURE (31)..(31): X is A or G
  MISC_FEATURE (32)..(32): X is A or G
  MISC_FEATURE (33)..(33): X is I, L or V
  MISC_FEATURE (34)..(34): X is F, W or Y for aromatic amino acids
  MISC_FEATURE (35)..(35): X is F, W or Y for aromatic amino acids
  MISC_FEATURE (36)..(36): X is K, R or H for basic amino acids
  MISC_FEATURE (37)..(37): X is I, L or V
  MISC_FEATURE (38)..(38): X is D and E for acidic amino acids
  MISC_FEATURE (39)..(39): X is I, L or V
  MISC_FEATURE (40)..(40): X is K, R or H for basic amino acids
  MISC_FEATURE (41)..(41): X is F, W or Y for aromatic amino acids
  MISC_FEATURE (42)..(42): X is I, L or V
  MISC_FEATURE (43)..(43): X is N or Q for amidated amino acids
  MISC_FEATURE (44)..(44): X is I, L or V
  MISC_FEATURE (45)..(45): X is A or G
  MISC_FEATURE (46)..(46): X is T or S

SEQ ID NO: 175 - protein, 39 aa, Artificial
  Completely synthesized peptide construct
DGQEEKAGVVSTGLIGGGMDFWCVEHDRPPPATPTSLTT

SEQ ID NO: 176 - protein, 39 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is  A or G
  MISC_FEATURE (8)..(8): X is  A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is M or Nle
  MISC_FEATURE (20)..(20): X is D and E for acidic amino acids
  MISC_FEATURE (21)..(21): X is F, W or Y for aromatic amino acids
  MISC_FEATURE (22)..(22): X is F, W or Y for aromatic amino acids
  MISC_FEATURE (23)..(23): X is C or S
  MISC_FEATURE (24)..(24): X is I, L or V
  MISC_FEATURE (25)..(25): X is D and E for acidic amino acids
  MISC_FEATURE (26)..(26): X is K, R or H for basic amino acids
  MISC_FEATURE (27)..(27): X is D and E for acidic amino acids
  MISC_FEATURE (28)..(28): X is K, R or H for basic amino acids
  MISC_FEATURE (29)..(29): X is F or P
  MISC_FEATURE (30)..(30): X is F or P
  MISC_FEATURE (31)..(31): X is F or P
  MISC_FEATURE (32)..(32): X is A  or G
  MISC_FEATURE (33)..(33): X is T or S
  MISC_FEATURE (34)..(34): X is F or P
  MISC_FEATURE (35)..(35): X is T or S
  MISC_FEATURE (36)..(36): X is C or S
  MISC_FEATURE (37)..(37): X is I, L or V
  MISC_FEATURE (38)..(38): X is T or S
  MISC_FEATURE (39)..(39): X is T or S
XXXXXXXXXXXXXXXXXXXXXXXXXXXXXXXXXXXXXXX

SEQ ID NO: 177 - protein, 38 aa, Artificial
  Completely synthesized peptide construct
DGQEEKAGVVSTGLIGGGNMYAMMIARFKMFPEVKEKG

SEQ ID NO: 178 - protein, 38 aa, Artificial; identical to SEQ ID NO: 162
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is N or Q for amidated amino acids
  MISC_FEATURE (20)..(20): X is M or Nle
  MISC_FEATURE (21)..(21): X is F, W or Y for aromatic amino acids
  MISC_FEATURE (22)..(22): X is A or G
  MISC_FEATURE (23)..(23): X is M or Nle
  MISC_FEATURE (24)..(24): X is M or Nle
  MISC_FEATURE (25)..(25): X is I, L or V
  MISC_FEATURE (26)..(26): X is A or G
  MISC_FEATURE (27)..(27): X is K, R or H for basic amino acids
  MISC_FEATURE (28)..(28): X is F, W or Y for aromatic amino acids
  MISC_FEATURE (29)..(29): X is K, R or H for basic amino acids
  MISC_FEATURE (30)..(30): X is M or Nle
  MISC_FEATURE (31)..(31): X is F, W or Y for aromatic amino acids
  MISC_FEATURE (32)..(32): X is F or P
  MISC_FEATURE (33)..(33): X is D and E for acidic amino acids
  MISC_FEATURE (34)..(34): X is I, L or V
  MISC_FEATURE (35)..(35): X is K, R or H for basic amino acids
  MISC_FEATURE (36)..(36): X is D and E for acidic amino acids
  MISC_FEATURE (37)..(37): X is K, R or H for basic amino acids
  MISC_FEATURE (38)..(38): X is A or G

SEQ ID NO: 179 - protein, 51 aa, Artificial
  Completely synthesized peptide construct
DGQEEKAGVVSTGLIGGGNMYAMMIARFKMFPEVKEKGMAALPRLIAFTSE

SEQ ID NO: 180 - protein, 51 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is N or Q for amidated amino acids
  MISC_FEATURE (20)..(20): X is M or Nle
  MISC_FEATURE (21)..(21): X is F, W or Y for aromatic amino acids
  MISC_FEATURE (22)..(22): X is A or G
  MISC_FEATURE (23)..(23): X is M or Nle
  MISC_FEATURE (24)..(24): X is M or Nle
  MISC_FEATURE (25)..(25): X is I, L or V
  MISC_FEATURE (26)..(26): X is A or G
  MISC_FEATURE (27)..(27): X is K, R or H for basic amino acids
  MISC_FEATURE (28)..(28): X is F, W or Y for aromatic amino acids
  MISC_FEATURE (29)..(29): X is K, R or H for basic amino acids
  MISC_FEATURE (30)..(30): X is M or Nle
  MISC_FEATURE (31)..(31): X is F, W or Y for aromatic amino acids
  MISC_FEATURE (32)..(32): X is F or P
  MISC_FEATURE (33)..(33): X is D and E for acidic amino acids
  MISC_FEATURE (34)..(34): X is I, L or V
  MISC_FEATURE (35)..(35): X is K, R or H for basic amino acids
  MISC_FEATURE (36)..(36): X is D and E for acidic amino acids
  MISC_FEATURE (37)..(37): X is K, R or H for basic amino acids
  MISC_FEATURE (38)..(38): X is A or G
  MISC_FEATURE (39)..(39): X is M or Nle
  MISC_FEATURE (40)..(40): X is A or G
  MISC_FEATURE (41)..(41): X is A or G
  MISC_FEATURE (42)..(42): X is I, L or V
  MISC_FEATURE (43)..(43): X is F or P
  MISC_FEATURE (44)..(44): X is K, R or H for basic amino acids
  MISC_FEATURE (45)..(45): X is I, L or V
  MISC_FEATURE (46)..(46): X is I, L or V
  MISC_FEATURE (47)..(47): X is A or G
  MISC_FEATURE (48)..(48): X is F, W or Y for aromatic amino acids
  MISC_FEATURE (49)..(49): X is T or S
  MISC_FEATURE (50)..(50): X is C or S
  MISC_FEATURE (51)..(51): X is D and E for acidic amino acids
XXXXXXXXXXXXXXXXXXXXXXXXXXXXXXXXXXXXXXXXXXXXXXXXXXX

SEQ ID NO: 181 - protein, 31 aa, Artificial
  Completely synthesized peptide construct
DGQEEKAGVVSTGLIGGGIAFTSEHSHFSLK

SEQ ID NO: 182 - protein, 31 aa, Artificial; identical to SEQ ID NO: 123
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is I, L or V
  MISC_FEATURE (20)..(20): X is A or G
  MISC_FEATURE (21)..(21): X is F, W or Y for aromatic amino acids
  MISC_FEATURE (22)..(22): X is T or S
  MISC_FEATURE (23)..(23): X is C or S
  MISC_FEATURE (24)..(24): X is D and E for acidic amino acids
  MISC_FEATURE (25)..(25): X is K, R or H for basic amino acids
  MISC_FEATURE (26)..(26): X is C or S
  MISC_FEATURE (27)..(27): X is K, R or H for basic amino acids
  MISC_FEATURE (28)..(28): X is F, W or Y for aromatic amino acids
  MISC_FEATURE (29)..(29): X is C or S
  MISC_FEATURE (30)..(30): X is I, L or V
  MISC_FEATURE (31)..(31): X is K, R or H for basic amino acids

SEQ ID NO: 183 - protein, 39 aa, Artificial; identical to SEQ ID NO: 176
  peptide construct
  MISC_FEATURE (1)..(1): X is D and E for acicid amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is M or Nle
  MISC_FEATURE (20)..(20): X is D and E for acidic amino acids
  MISC_FEATURE (21)..(21): X is F, W or Y for aromatic amino acids
  MISC_FEATURE (22)..(22): X is F, W or Y for aromatic amino acids
  MISC_FEATURE (23)..(23): X is C or S
  MISC_FEATURE (24)..(24): X is I, L or V
  MISC_FEATURE (25)..(25): X is D and E for acidic amino acids
  MISC_FEATURE (26)..(26): X is K, R or H for basic amino acids
  MISC_FEATURE (27)..(27): X is D and E for acidic amino acids
  MISC_FEATURE (28)..(28): X is K, R or H for basic amino acids
  MISC_FEATURE (29)..(29): X is F or P
  MISC_FEATURE (30)..(30): X is F or P
  MISC_FEATURE (31)..(31): X is F or P
  MISC_FEATURE (32)..(32): X is A or G
  MISC_FEATURE (33)..(33): X is T or S
  MISC_FEATURE (34)..(34): X is F or P
  MISC_FEATURE (35)..(35): X is T or S
  MISC_FEATURE (36)..(36): X is C or S
  MISC_FEATURE (37)..(37): X is I, L or V
  MISC_FEATURE (38)..(38): X is T or S
  MISC_FEATURE (39)..(39): X is T or S

SEQ ID NO: 184 - protein, 28 aa, Artificial
  Completely synthesized peptide construct
DGQEEKAGVVSTGLIGGGERPTLAFLQD

SEQ ID NO: 185 - protein, 28 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is D and E for acidic amino acids
  MISC_FEATURE (20)..(20): X is K, R or H for basic amino acids
  MISC_FEATURE (21)..(21): X is F or P
  MISC_FEATURE (22)..(22): X is T or S
  MISC_FEATURE (23)..(23): X is I, L or V
  MISC_FEATURE (24)..(24): X is A or G
  MISC_FEATURE (25)..(25): X is F, W or Y for aromatic amino acids
  MISC_FEATURE (26)..(26): X is I, L or V
  MISC_FEATURE (27)..(27): X is N or Q for amidated amino acids
  MISC_FEATURE (28)..(28): X is D and E for acidic amino acids
XXXXXXXXXXXXXXXXXXXXXXXXXXXX

SEQ ID NO: 186 - protein, 28 aa, Artificial
  Completely synthesized peptide construct
DGQEEKAGVVSTGLIGGGDRSTKVIDFH

SEQ ID NO: 187 - protein, 28 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is  Tor S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is D and E for acidic amino acids
  MISC_FEATURE (20)..(20): X is K, R or H for basic amino acids
  MISC_FEATURE (21)..(21): X is C or S
  MISC_FEATURE (22)..(22): X is T or S
  MISC_FEATURE (23)..(23): X is K, R or H for basic amino acids
  MISC_FEATURE (24)..(24): X is I, L or V
  MISC_FEATURE (25)..(25): X is I, L or V
  MISC_FEATURE (26)..(26): X is D and E for acidic amino acids
  MISC_FEATURE (27)..(27): X is F, W or Y for aromatic amino acids
  MISC_FEATURE (28)..(28): X is K, R or H for basic amino acids
XXXXXXXXXXXXXXXXXXXXXXXXXXXX

SEQ ID NO: 188 - protein, 31 aa, Artificial
  Completely synthesized peptide construct
DGQEEKAGVVSTGLIGGGIAGFKGEQGPKGE

SEQ ID NO: 189 - protein, 31 aa, Artificial; identical to SEQ ID NO: 123
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is I, L or V
  MISC_FEATURE (20)..(20): X is A or G
  MISC_FEATURE (21)..(21): X is A or G
  MISC_FEATURE (22)..(22): X is F, W or Y for aromatic amino acids
  MISC_FEATURE (23)..(23): X is K, R or H for basic amino acids
  MISC_FEATURE (24)..(24): X is A or G
  MISC_FEATURE (25)..(25): X is D and E for acidic amino acids
  MISC_FEATURE (26)..(26): X is N or Q for amidated amino acids
  MISC_FEATURE (27)..(27): X is A or G
  MISC_FEATURE (28)..(28): X is F or P
  MISC_FEATURE (29)..(29): X is K, R or H for basic amino acids
  MISC_FEATURE (30)..(30): X is A or G
  MISC_FEATURE (31)..(31): X is D and E for acidic amino acids

SEQ ID NO: 190 - protein, 4 aa, Artificial
  Completely synthesized peptide construct
  MISC_FEATURE (1)..(1): X is TEST TEST TEST TEST TEST
  misc_feature (2)..(4): Xaa can be any naturally occurring amino acid
XXXX

SEQ ID NO: 191 - protein, 18 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
XXXXXXXXXXXXXXXXXX

SEQ ID NO: 192 - protein, 26 aa, Artificial
  Completely synthesized peptide construct
DGQEEKAGVVSTGLIGGGKNIVTPRT

SEQ ID NO: 193 - protein, 26 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is K, R or H for basic amino acids
  MISC_FEATURE (20)..(20): X is N or Q for amidated amino acids
  MISC_FEATURE (21)..(21): X is I, L or V
  MISC_FEATURE (22)..(22): X is I, L or V
  MISC_FEATURE (23)..(23): X is T or S
  MISC_FEATURE (24)..(24): X is F or P
  MISC_FEATURE (25)..(25): X is K, R or H for basic amino acids
  MISC_FEATURE (26)..(26): X is T or  S
XXXXXXXXXXXXXXXXXXXXXXXXXX

SEQ ID NO: 194 - protein, 33 aa, Artificial
  Completely synthesized peptide construct
DGQEEKAGVVSTGLIGGGGDKVSFFCKNKEKKC

SEQ ID NO: 195 - protein, 33 aa, Artificial; identical to SEQ ID NO: 97
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is A or G
  MISC_FEATURE (20)..(20): X is D and E for acidic amino acids
  MISC_FEATURE (21)..(21): X is K, R or H for basic amino acids
  MISC_FEATURE (22)..(22): X is I, L or V
  MISC_FEATURE (23)..(23): X is C or S
  MISC_FEATURE (24)..(24): X is F, W or Y for aromatic amino acids
  MISC_FEATURE (25)..(25): X is F, W or Y for aromatic amino acids
  MISC_FEATURE (26)..(26): X is C or S
  MISC_FEATURE (27)..(27): X is K, R or H for basic amino acids
  MISC_FEATURE (28)..(28): X is N or Q for amidated amino acids
  MISC_FEATURE (29)..(29): X is K, R or H for basic amino acids
  MISC_FEATURE (30)..(30): X is D and E for acidic amino acids
  MISC_FEATURE (31)..(31): X is K, R or H for basic amino acids
  MISC_FEATURE (32)..(32): X is K, R or H for basic amino acids
  MISC_FEATURE (33)..(33): X is C or S

SEQ ID NO: 196 - protein, 35 aa, Artificial
  Completely synthesized peptide construct
DGQEEKAGVVSTGLIGGGEIIVTHFPFDEQNCSMK

SEQ ID NO: 197 - protein, 35 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is D and E for acidic amino acids
  MISC_FEATURE (20)..(20): X is I, L or V
  MISC_FEATURE (21)..(21): X is I, L or V
  MISC_FEATURE (22)..(22): X is I, L or V
  MISC_FEATURE (23)..(23): X is T or S
  MISC_FEATURE (24)..(24): X is K, R or H for basic amino acids
  MISC_FEATURE (25)..(25): X is F, W or Y for aromatic amino acids
  MISC_FEATURE (26)..(26): X is F or P
  MISC_FEATURE (27)..(27): X is F, W or Y for aromatic amino acids
  MISC_FEATURE (28)..(28): X is D and E for acidic amino acids
  MISC_FEATURE (29)..(29): X is D and E for acidic amino acids
  MISC_FEATURE (30)..(30): X is N or Q for amidated amino acids
  MISC_FEATURE (31)..(31): X is N or Q for amidated amino acids
  MISC_FEATURE (32)..(32): X is C or S
  MISC_FEATURE (33)..(33): X is C or S
  MISC_FEATURE (34)..(34): X is M or Nle
  MISC_FEATURE (35)..(35): X is K, R or H for basic  amino acids
XXXXXXXXXXXXXXXXXXXXXXXXXXXXXXXXXXX

SEQ ID NO: 198 - protein, 31 aa, Artificial
  Completely synthesized peptide construct
DGQEEKAGVVSTGLIGGGVHFFKNIVTPRTP

SEQ ID NO: 199 - protein, 31 aa, Artificial; identical to SEQ ID NO: 123
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is I, L or V
  MISC_FEATURE (20)..(20): X is K, R or H for basic amino acids
  MISC_FEATURE (21)..(21): X is F, W or Y for aromatic amino acids
  MISC_FEATURE (22)..(22): X is F, W or Y for aromatic amino acids
  MISC_FEATURE (23)..(23): X is K,  R or H for basic amino acids
  MISC_FEATURE (24)..(24): X is N or Q for amidated amino acids
  MISC_FEATURE (25)..(25): X is I, L or V
  MISC_FEATURE (26)..(26): X is I, L or V
  MISC_FEATURE (27)..(27): X is T or S
  MISC_FEATURE (28)..(28): X is F or P
  MISC_FEATURE (29)..(29): X is K, R or H for basic amino acids
  MISC_FEATURE (30)..(30): X is T or S
  MISC_FEATURE (31)..(31): X is F or P

SEQ ID NO: 200 - protein, 35 aa, Artificial
  Completely synthesized peptide construct
DGQEEKAGVVSTGLIGGGYQQLNSERGVPNENIEN

SEQ ID NO: 201 - protein, 35 aa, Artificial; identical to SEQ ID NO: 197
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is F, W or Y for aromatic amino acids
  MISC_FEATURE (20)..(20): X is N or Q for amidated amino acids
  MISC_FEATURE (21)..(21): X is N or Q for amidated amino acids
  MISC_FEATURE (22)..(22): X is I, L or V
  MISC_FEATURE (23)..(23): X is N or Q for amidated amino acids
  MISC_FEATURE (24)..(24): X is C or S
  MISC_FEATURE (25)..(25): X is D and E for acidic amino acids
  MISC_FEATURE (26)..(26): X is K, R or H for basic amino acids
  MISC_FEATURE (27)..(27): X is A or G
  MISC_FEATURE (28)..(28): X is I, L or V
  MISC_FEATURE (29)..(29): X is F or P
  MISC_FEATURE (30)..(30): X is N or Q for amidated amino acids
  MISC_FEATURE (31)..(31): X is D and E for acidic amino acids
  MISC_FEATURE (32)..(32): X is N or Q for amidated amino acids
  MISC_FEATURE (33)..(33): X is I, L or V
  MISC_FEATURE (34)..(34): X is D and E for acidic amino acids
  MISC_FEATURE (35)..(35): X is N or Q for amidated amino acids

SEQ ID NO: 202 - protein, 31 aa, Artificial
  Completely synthesized peptide construct
DGQEEKAGVVSTGLIGGGVFIKRVSNVIIHG

SEQ ID NO: 203 - protein, 31 aa, Artificial; identical to SEQ ID NO: 123
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is I, L or V
  MISC_FEATURE (20)..(20): X is F, W or Y for aromatic amino acids
  MISC_FEATURE (21)..(21): X is I, L or V
  MISC_FEATURE (22)..(22): X is K, R or H for basic amino acids
  MISC_FEATURE (23)..(23): X is K, R or H for basic amino acids
  MISC_FEATURE (24)..(24): X is I, L or V
  MISC_FEATURE (25)..(25): X is C or S
  MISC_FEATURE (26)..(26): X is N or Q for amidated amino acids
  MISC_FEATURE (27)..(27): X is I, L or V
  MISC_FEATURE (28)..(28): X is I, L or V
  MISC_FEATURE (29)..(29): X is I, L or V
  MISC_FEATURE (30)..(30): X is K, R or H for basic amino acids
  MISC_FEATURE (31)..(31): X is A or G

SEQ ID NO: 204 - protein, 33 aa, Artificial
  Completely synthesized peptide construct
DGQEEKAGVVSTGLIGGGMKVTVAFNQFGPNRR

SEQ ID NO: 205 - protein, 33 aa, Artificial; identical to SEQ ID NO: 97
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is M or Nle
  MISC_FEATURE (20)..(20): X is K, R or H for basic amino acids
  MISC_FEATURE (21)..(21): X is I, L or V
  MISC_FEATURE (22)..(22): X is T or S
  MISC_FEATURE (23)..(23): X is I, L or V
  MISC_FEATURE (24)..(24): X is A or G
  MISC_FEATURE (25)..(25): X is F, W or Y for aromatic amino acids
  MISC_FEATURE (26)..(26): X is N or Q for amidated amino acids
  MISC_FEATURE (27)..(27): X is N or Q for amidated amino acids
  MISC_FEATURE (28)..(28): X is F, W or Y for aromatic amino acids
  MISC_FEATURE (29)..(29): X is A or G
  MISC_FEATURE (30)..(30): X is F or P
  MISC_FEATURE (31)..(31): X is N or Q for amidated amino acids
  MISC_FEATURE (32)..(32): X is K, R or H for basic amino acids
  MISC_FEATURE (33)..(33): X is K, R or H for basic amino acids

SEQ ID NO: 206 - protein, 33 aa, Artificial
  Completely synthesized peptide construct
DGQEEKAGVVSTGLIGGGIASRRVDGIIAAYQN

SEQ ID NO: 207 - protein, 33 aa, Artificial; identical to SEQ ID NO: 97
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is I, L or V
  MISC_FEATURE (20)..(20): X is A or G
  MISC_FEATURE (21)..(21): X is C or S
  MISC_FEATURE (22)..(22): X is K, Ror H for basic amino acids
  MISC_FEATURE (23)..(23): X is K, R or H for basic amino acids
  MISC_FEATURE (24)..(24): X is I, L or V
  MISC_FEATURE (25)..(25): X is D and E for acidic amino acids
  MISC_FEATURE (26)..(26): X is A or G
  MISC_FEATURE (27)..(27): X is I, L or V
  MISC_FEATURE (28)..(28): X is I, L or V
  MISC_FEATURE (29)..(29): X is A or G
  MISC_FEATURE (30)..(30): X is A or G
  MISC_FEATURE (31)..(31): X is F, W or Y for aromatic amino acids
  MISC_FEATURE (32)..(32): X is N or Q for amidated amino acids
  MISC_FEATURE (33)..(33): X is N or Q for amidated amino acids

SEQ ID NO: 208 - protein, 38 aa, Artificial
  Completely synthesized peptide construct
DGQEEKAGVVSTGLIGGGGIDIFASKNFHLQKNTIGTG

SEQ ID NO: 209 - protein, 37 aa, Artificial; identical to SEQ ID NO: 151
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is I, L or V
  MISC_FEATURE (20)..(20): X is D and E for acidic amino acids
  MISC_FEATURE (21)..(21): X is I, L or V
  MISC_FEATURE (22)..(22): X is F, W or Y for aromatic amino acids
  MISC_FEATURE (23)..(23): X is A or G
  MISC_FEATURE (24)..(24): X is C or S
  MISC_FEATURE (25)..(25): X is K, R or H for basic amino acids
  MISC_FEATURE (26)..(26): X is N or Q for amidated amino acids
  MISC_FEATURE (27)..(27): X is F, W or Y for aromatic amino acids
  MISC_FEATURE (28)..(28): X is K, R or H for basic amino acids
  MISC_FEATURE (29)..(29): X is I, L or V
  MISC_FEATURE (30)..(30): X is N or Q for amidated amino acids
  MISC_FEATURE (31)..(31): X is K, R or H for basic amino acids
  MISC_FEATURE (32)..(32): X is N or Q for amidated amino acids
  MISC_FEATURE (33)..(33): X is T or S
  MISC_FEATURE (34)..(34): X is I, L or V
  MISC_FEATURE (35)..(35): X is A or G
  MISC_FEATURE (36)..(36): X is T or S
  MISC_FEATURE (37)..(37): X is A or G

SEQ ID NO: 210 - protein, 43 aa, Artificial
  Completely synthesized peptide construct
DGQEEKAGVVSTGLIGGGGIGAVLKVLTTGPALISWIKRKRQQ

SEQ ID NO: 211 - protein, 43 aa, Artificial
  peptide construct
  MISC_FEATURE (1)..(1): X is D and E for acidic amino acids
  MISC_FEATURE (2)..(2): X is A or G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A or G
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A or G
  MISC_FEATURE (14)..(14): X is I, L or V
  MISC_FEATURE (15)..(15): X is I, L or V
  MISC_FEATURE (16)..(16): X is A or G
  MISC_FEATURE (17)..(17): X is A or G
  MISC_FEATURE (18)..(18): X is A or G
  MISC_FEATURE (19)..(19): X is A or G
  MISC_FEATURE (20)..(20): X is I, L or V
  MISC_FEATURE (21)..(21): X is A or G
  MISC_FEATURE (22)..(22): X is A or G
  MISC_FEATURE (23)..(23): X is I, L or V
  MISC_FEATURE (24)..(24): X is I, L or V
  MISC_FEATURE (25)..(25): X is K, R or H for basic amino acids
  MISC_FEATURE (26)..(26): X is I, L or V
  MISC_FEATURE (27)..(27): X is I, L or V
  MISC_FEATURE (28)..(28): X is T or S
  MISC_FEATURE (29)..(29): X is T or S
  MISC_FEATURE (30)..(30): X is A or G
  MISC_FEATURE (31)..(31): X is F or P
  MISC_FEATURE (32)..(32): X is A or G
  MISC_FEATURE (33)..(33): X is I, L or V
  MISC_FEATURE (34)..(34): X is I, L or V
  MISC_FEATURE (35)..(35): X is C or S
  MISC_FEATURE (36)..(36): X is F, W or Y for aromatic amino acids
  MISC_FEATURE (37)..(37): X is I, L or V
  MISC_FEATURE (38)..(38): X is K, R or H for basic amino acids
  MISC_FEATURE (39)..(39): X is K, R or H for basic amino acids
  MISC_FEATURE (40)..(40): X is K, R or H for basic amino acids
  MISC_FEATURE (41)..(41): X is K, R or H for basic amino acids
  MISC_FEATURE (42)..(42): X is N or Q for amidated amino acids
  MISC_FEATURE (43)..(43): X is N or Q for amidated amino acids
XXXXXXXXXXXXXXXXXXXXXXXXXXXXXXXXXXXXXXXXXXX

SEQ ID NO: 212 - protein, 58 aa, Artificial
  Completely synthesized peptide construct
DAEFRHDSGYEVHHQKLVFFAEDVGSKNGAIIGLMVGGVVGGGDGQEEKAGVVSTGLI

SEQ ID NO: 213 - protein, 58 aa, Artificial; identical to SEQ ID NO: 135
  peptide construct
  MISC_FEATURE (1)..(1): X is D and E for acidic amino acids
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F,  W or Y for aromatic amino acids
  MISC_FEATURE (11)..(11): X is D and E for acidic amino acids
  MISC_FEATURE (12)..(12): X is I, L or V
  MISC_FEATURE (13)..(13): X is K, R or H for basic amino acids
  MISC_FEATURE (14)..(14): X is K, R or H for basic amino acids
  MISC_FEATURE (15)..(15): X is N or Q for amidated amino acids
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is F, W or Y for aromatic amino acids
  MISC_FEATURE (20)..(20): X is F, W or Y for aromatic amino acids
  MISC_FEATURE (21)..(21): X is A or G
  MISC_FEATURE (22)..(22): X is D and E for acidic amino acids
  MISC_FEATURE (23)..(23): X is D and E for acidic amino acids
  MISC_FEATURE (24)..(24): X is I, L or V
  MISC_FEATURE (25)..(25): X is A or G
  MISC_FEATURE (26)..(26): X is C or S
  MISC_FEATURE (27)..(27): X is N or Q for amidated amino acids
  MISC_FEATURE (28)..(28): X is K, R or H for basic amino acids
  MISC_FEATURE (29)..(29): X is A or G
  MISC_FEATURE (30)..(30): X is A or G
  MISC_FEATURE (31)..(31): X is I, L or V
  MISC_FEATURE (32)..(32): X is I, L or V
  MISC_FEATURE (33)..(33): X is A or G
  MISC_FEATURE (34)..(34): X is I, L or V
  MISC_FEATURE (35)..(35): X is M or Nle
  MISC_FEATURE (36)..(36): X is I, L or V
  MISC_FEATURE (37)..(37): X is A or G
  MISC_FEATURE (38)..(38): X is A or G
  MISC_FEATURE (39)..(39): X is I, L or V
  MISC_FEATURE (40)..(40): X is I, L or V
  MISC_FEATURE (41)..(41): X is A and G
  MISC_FEATURE (42)..(42): X is A or G
  MISC_FEATURE (43)..(43): X is A and G
  MISC_FEATURE (44)..(44): X is D and E for acidic amino acids
  MISC_FEATURE (45)..(45): X is A and G
  MISC_FEATURE (46)..(46): X is N or Q for amidated amino acids
  MISC_FEATURE (47)..(47): X is D and E for acidic amino acids
  MISC_FEATURE (48)..(48): X is D and E for acidic amino acids
  MISC_FEATURE (49)..(49): X is K, R or H for basic amino acids
  MISC_FEATURE (50)..(50): X is A and G
  MISC_FEATURE (51)..(51): X is A and G
  MISC_FEATURE (52)..(52): X is I, L or V
  MISC_FEATURE (53)..(53): X is I, L or V
  MISC_FEATURE (54)..(54): X is C or S
  MISC_FEATURE (55)..(55): X is T or S
  MISC_FEATURE (56)..(56): X is A and G
  MISC_FEATURE (57)..(57): X is I, L or V
  MISC_FEATURE (58)..(58): X is I, L or V

SEQ ID NO: 214 - protein, 46 aa, Artificial
  Completely synthesized peptide construct
DAEFRHDSGYEVHHQKLVFFAENVGSNKGGGDGQEEKAGVVSTGLI

SEQ ID NO: 215 - protein, 46 aa, Artificial; identical to SEQ ID NO: 137
  peptide construct
  MISC_FEATURE (1)..(1): X is D and E for acidic amino acids
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is Tor S
  MISC_FEATURE (9)..(9): X is A or G
  MISC_FEATURE (10)..(10): X is F, W or Y for aromatic amino acids
  MISC_FEATURE (11)..(11): X is D and E for acidic amino acids
  MISC_FEATURE (12)..(12): X is I, L or V
  MISC_FEATURE (13)..(13): X is K, R or H for basic amino acids
  MISC_FEATURE (14)..(14): X is K, R or H for basic amino acids
  MISC_FEATURE (15)..(15): X is N or Q for amidated amino acids
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is F, W or Y for aromatic amino acids
  MISC_FEATURE (20)..(20): X is F, W or Y for aromatic amino acids
  MISC_FEATURE (21)..(21): X is A or G
  MISC_FEATURE (22)..(22): X is D and E for acidic amino acids
  MISC_FEATURE (23)..(23): X is D and E for acidic amino acids
  MISC_FEATURE (24)..(24): X is I, L or V
  MISC_FEATURE (25)..(25): X is A or G
  MISC_FEATURE (26)..(26): X is C or S
  MISC_FEATURE (27)..(27): X is N or Q for amidated amino acids
  MISC_FEATURE (28)..(28): X is K, R or H for basic amino acids
  MISC_FEATURE (29)..(29): X is A and G
  MISC_FEATURE (30)..(30): X is A or G
  MISC_FEATURE (31)..(31): X is A and G
  MISC_FEATURE (32)..(32): X is D and E for acidic amino acids
  MISC_FEATURE (33)..(33): X is A and G
  MISC_FEATURE (34)..(34): X is N or Q for amidated amino acids
  MISC_FEATURE (35)..(35): X is D and E for acidic amino acids
  MISC_FEATURE (36)..(36): X is D and E for acidic amino acids
  MISC_FEATURE (37)..(37): X is K, R or H for basic amino acids
  MISC_FEATURE (38)..(38): X is A andG
  MISC_FEATURE (39)..(39): X is A and G
  MISC_FEATURE (40)..(40): X is I, L or V
  MISC_FEATURE (41)..(41): X is I, L or V
  MISC_FEATURE (42)..(42): X is C or S
  MISC_FEATURE (43)..(43): X is T or S
  MISC_FEATURE (44)..(44): X is A or G
  MISC_FEATURE (45)..(45): X is I, L or V
  MISC_FEATURE (46)..(46): X is I, L or V

SEQ ID NO: 216 - protein, 48 aa, Artificial
  Completely synthesized peptide construct
DAEFRHDSGYEVHHQKLVFFAENVGSNKAIGGGDGQEEKAGVVSTGLI

SEQ ID NO: 217 - protein, 48 aa, Artificial; identical to SEQ ID NO: 139
  peptide construct
  MISC_FEATURE (1)..(1): X is D and E for acidic amino acids
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F, W or Y for aromatic amino acids
  MISC_FEATURE (11)..(11): X is D and E for acidic amino acids
  MISC_FEATURE (12)..(12): X is I, L or V
  MISC_FEATURE (13)..(13): X is K, R or H for basic amino acids
  MISC_FEATURE (14)..(14): X is K, R or H for basic amino acids
  MISC_FEATURE (15)..(15): X is N or Q for amidated amino acids
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is F, W or Y for aromatic amino acids
  MISC_FEATURE (20)..(20): X is F, W or Y for aromatic amino acids
  MISC_FEATURE (21)..(21): X is A or G
  MISC_FEATURE (22)..(22): X is D and E for acidic amino acids
  MISC_FEATURE (23)..(23): X is D and E for acidic amino acids
  MISC_FEATURE (24)..(24): X is I, L or V
  MISC_FEATURE (25)..(25): X is A or G
  MISC_FEATURE (26)..(26): X is C or S
  MISC_FEATURE (27)..(27): X is N or Q for amidated amino acids
  MISC_FEATURE (28)..(28): X is K, R or H for basic amino acids
  MISC_FEATURE (29)..(29): X is A  or G
  MISC_FEATURE (30)..(30): X is I, L or V
  MISC_FEATURE (31)..(31): X is A and G
  MISC_FEATURE (32)..(32): X is A or G
  MISC_FEATURE (33)..(33): X is A and G
  MISC_FEATURE (34)..(34): X is D and E for acidic amino acids
  MISC_FEATURE (35)..(35): X is A and G
  MISC_FEATURE (36)..(36): X is  N or Q for amidated amino acids
  MISC_FEATURE (37)..(37): X is D and E for acidic amino acids
  MISC_FEATURE (38)..(38): X is D and E for acidic amino acids
  MISC_FEATURE (39)..(39): X is K, R or H for basic amino acids
  MISC_FEATURE (40)..(40): X is A and G
  MISC_FEATURE (41)..(41): X is A and G
  MISC_FEATURE (42)..(42): X is I, L or V
  MISC_FEATURE (43)..(43): X is I, L or V
  MISC_FEATURE (44)..(44): X is C or S
  MISC_FEATURE (45)..(45): X is T or S
  MISC_FEATURE (46)..(46): X is A or G
  MISC_FEATURE (47)..(47): X is I, L or V
  MISC_FEATURE (48)..(48): X is I, L or V

SEQ ID NO: 218 - protein, 29 aa, Artificial
  Completely synthesized peptide construct
DAEFRHDSGYEGGGDGQEEKAGVVSTGLI

SEQ ID NO: 219 - protein, 29 aa, Artificial
  peptide construct
  MISC_FEATURE (1)..(1): X is D and E for acidic amino acids
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F, W or Y for aromatic amino acids
  MISC_FEATURE (11)..(11): X is D and E for acidic amino acids
  MISC_FEATURE (12)..(12): X is A and G
  MISC_FEATURE (13)..(13): X is A or G
  MISC_FEATURE (14)..(14): X is A and G
  MISC_FEATURE (15)..(15): X is D and E for acidic amino acids
  MISC_FEATURE (16)..(16): X is A and G
  MISC_FEATURE (17)..(17): X is N or Q for amidated amino acids
  MISC_FEATURE (18)..(18): X is D and E for acidic amino acids
  MISC_FEATURE (19)..(19): X is D and E for acidic amino acids
  MISC_FEATURE (20)..(20): X is K, R or H for basic amino acids
  MISC_FEATURE (21)..(21): X is A and G
  MISC_FEATURE (22)..(22): X is A and G
  MISC_FEATURE (23)..(23): X is I, L or V
  MISC_FEATURE (24)..(24): X is I, L or V
  MISC_FEATURE (25)..(25): X is C or S
  MISC_FEATURE (26)..(26): X is T or S
  MISC_FEATURE (27)..(27): X is A or G
  MISC_FEATURE (28)..(28): X is I, L or V
  MISC_FEATURE (29)..(29): X is I, L or V
XXXXXXXXXXXXXXXXXXXXXXXXXXXXX

SEQ ID NO: 220 - protein, 25 aa, Artificial
  Completely synthesized peptide construct
EVNGSNKGGGDGQEEKAGVVSTGLI

SEQ ID NO: 221 - protein, 25 aa, Artificial
  peptide construct
  MISC_FEATURE (1)..(1): X is Dand E for acidic amino acids
  MISC_FEATURE (2)..(2): X is Dand E for acidic amino acids
  MISC_FEATURE (3)..(3): X is I, L or V
  MISC_FEATURE (4)..(4): X is A or G
  MISC_FEATURE (5)..(5): X is C or S
  MISC_FEATURE (6)..(6): X is N or Q for amidated amino acids
  MISC_FEATURE (7)..(7): X is K, R or H for basic amino acids
  MISC_FEATURE (8)..(8): X is A and G
  MISC_FEATURE (9)..(9): X is A or G
  MISC_FEATURE (10)..(10): X is A and G
  MISC_FEATURE (11)..(11): X is D and E for acidic amino acids
  MISC_FEATURE (12)..(12): X is A and G
  MISC_FEATURE (13)..(13): X is N or Q for amidated amino acids
  MISC_FEATURE (14)..(14): X is D andE for acidic amino acids
  MISC_FEATURE (15)..(15): X is D and E for acidic amino acids
  MISC_FEATURE (16)..(16): X is K, R or H for basic amino acids
  MISC_FEATURE (17)..(17): X is A and G
  MISC_FEATURE (18)..(18): X is A and G
  MISC_FEATURE (19)..(19): X is I, L or V
  MISC_FEATURE (20)..(20): X is I, L or V
  MISC_FEATURE (21)..(21): X is C or S
  MISC_FEATURE (22)..(22): X is T or S
  MISC_FEATURE (23)..(23): X is A  or G
  MISC_FEATURE (24)..(24): X is I, L or V
  MISC_FEATURE (25)..(25): X is I, L or V
XXXXXXXXXXXXXXXXXXXXXXXXX

SEQ ID NO: 222 - protein, 30 aa, Artificial
  Completely synthesized peptide construct
DAEFRHDSGYEVGGGDGQEEKAGVVSTGLI

SEQ ID NO: 223 - protein, 30 aa, Artificial; identical to SEQ ID NO: 56
  peptide construct
  MISC_FEATURE (1)..(1): X is D and E for acidic amino acids
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F, W or Y for aromatic amino acids
  MISC_FEATURE (11)..(11): X is D and E for acidic amino acids
  MISC_FEATURE (12)..(12): X is I, L or V
  MISC_FEATURE (13)..(13): X is A and G
  MISC_FEATURE (14)..(14): X is A or G
  MISC_FEATURE (15)..(15): X is A and G
  MISC_FEATURE (16)..(16): X is D and E for acidic amino acids
  MISC_FEATURE (17)..(17): X is A and G
  MISC_FEATURE (18)..(18): X is N or Q for amidated amino acids
  MISC_FEATURE (19)..(19): X is D and E for acidic amino acids
  MISC_FEATURE (20)..(20): X is D and E for acidic amino acids
  MISC_FEATURE (21)..(21): X is K, R or H for basic amino acids
  MISC_FEATURE (22)..(22): X is A and G
  MISC_FEATURE (23)..(23): X is A and G
  MISC_FEATURE (24)..(24): X is I, L or V
  MISC_FEATURE (25)..(25): X is I, L or V
  MISC_FEATURE (26)..(26): X is C or S
  MISC_FEATURE (27)..(27): X is T or S
  MISC_FEATURE (28)..(28): X is A or G
  MISC_FEATURE (29)..(29): X is I, L or V
  MISC_FEATURE (30)..(30): X is I, L or V

SEQ ID NO: 224 - protein, 28 aa, Artificial
  Completely synthesized peptide construct
DAEFRHDSGYGGGDGQEEKAGVVSTGLI

SEQ ID NO: 225 - protein, 28 aa, Artificial
  peptide construct
  MISC_FEATURE (1)..(1): X is D and E for acidic amino acids
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is  T or S
  MISC_FEATURE (9)..(9): X is A or G
  MISC_FEATURE (10)..(10): X is F, W or Y for aromatic amino acids
  MISC_FEATURE (11)..(11): X is A and G
  MISC_FEATURE (12)..(12): X is A or G
  MISC_FEATURE (13)..(13): X is A and G
  MISC_FEATURE (14)..(14): X is D and E for acidic amino acids
  MISC_FEATURE (15)..(15): X is A and G
  MISC_FEATURE (16)..(16): X is N or Q for amidated amino acids
  MISC_FEATURE (17)..(17): X is D and E for acidic amino acids
  MISC_FEATURE (18)..(18): X is D and E for acidic amino acids
  MISC_FEATURE (19)..(19): X is K, R or H for basic amino acids
  MISC_FEATURE (20)..(20): X is A and G
  MISC_FEATURE (21)..(21): X is A and G
  MISC_FEATURE (22)..(22): X is I, L or V
  MISC_FEATURE (23)..(23): X is I, L or V
  MISC_FEATURE (24)..(24): X is C or S
  MISC_FEATURE (25)..(25): X is T or S
  MISC_FEATURE (26)..(26): X is A or G
  MISC_FEATURE (27)..(27): X is I, L or V
  MISC_FEATURE (28)..(28): X is I, L or V
XXXXXXXXXXXXXXXXXXXXXXXXXXXX

SEQ ID NO: 226 - protein, 22 aa, Artificial
  Completely synthesized peptide construct
EFRHGGGDGQEEKAGVVSTGLI

SEQ ID NO: 227 - protein, 22 aa, Artificial
  peptide construct
  MISC_FEATURE (1)..(1): X is D and E for acidic amino acids
  MISC_FEATURE (2)..(2): X is F or  P
  MISC_FEATURE (3)..(3): X is K, R or H for basic amino acids
  MISC_FEATURE (4)..(4): X is K, R or H for basic amino acids
  MISC_FEATURE (5)..(5): X is A and G
  MISC_FEATURE (6)..(6): X is A or G
  MISC_FEATURE (7)..(7): X is A and G
  MISC_FEATURE (8)..(8): X is D and E for acidic amino acids
  MISC_FEATURE (9)..(9): X is A and G
  MISC_FEATURE (10)..(10): X is N or Q for amidated amino acids
  MISC_FEATURE (11)..(11): X is D and E for acidic amino acids
  MISC_FEATURE (12)..(12): X is D and E for acidic amino acids
  MISC_FEATURE (13)..(13): X is K, R or H for basic amino acids
  MISC_FEATURE (14)..(14): X is A and G
  MISC_FEATURE (15)..(15): X is A and G
  MISC_FEATURE (16)..(16): X is I, L or V
  MISC_FEATURE (17)..(17): X is I, L or V
  MISC_FEATURE (18)..(18): X is C or S
  MISC_FEATURE (19)..(19): X is T or S
  MISC_FEATURE (20)..(20): X is A or G
  MISC_FEATURE (21)..(21): X is I, L or V
  MISC_FEATURE (22)..(22): X is I, L or V
XXXXXXXXXXXXXXXXXXXXXX

SEQ ID NO: 228 - protein, 37 aa, Artificial
  Completely synthesized peptide construct
DSAFDVLSFTAEEKAGVYKGGGDGQEEKAGVVSTGLI

SEQ ID NO: 229 - protein, 37 aa, Artificial; identical to SEQ ID NO: 151
  peptide construct
  MISC_FEATURE (1)..(1): X is D and E for acidic amino acids
  MISC_FEATURE (2)..(2): X is C or S
  MISC_FEATURE (3)..(3): X is A or G
  MISC_FEATURE (4)..(4): X is F, W or Y for aromatic amino acids
  MISC_FEATURE (5)..(5): X is D and E for acidic amino acids
  MISC_FEATURE (6)..(6): X is I, L or V
  MISC_FEATURE (7)..(7): X is I, L or V
  MISC_FEATURE (8)..(8): X is C or S
  MISC_FEATURE (9)..(9): X is F, W or Y for aromatic amino acids
  MISC_FEATURE (10)..(10): X is T or S
  MISC_FEATURE (11)..(11): X is A or G
  MISC_FEATURE (12)..(12): X is D and E for acidic amino acids
  MISC_FEATURE (13)..(13): X is D and E for acidic amino acids
  MISC_FEATURE (14)..(14): X is K, R or H for basic amino acids
  MISC_FEATURE (15)..(15): X is A or G
  MISC_FEATURE (16)..(16): X is A or G
  MISC_FEATURE (17)..(17): X is I, L or V
  MISC_FEATURE (18)..(18): X is F, W or Y for aromatic amino acids
  MISC_FEATURE (19)..(19): X is K, R or H for basic amino acids
  MISC_FEATURE (20)..(20): X is A and G
  MISC_FEATURE (21)..(21): X is A or G
  MISC_FEATURE (22)..(22): X is A and G
  MISC_FEATURE (23)..(23): X is D and E for acidic amino acids
  MISC_FEATURE (24)..(24): X is A and G
  MISC_FEATURE (25)..(25): X is N or Q for amidated amino acids
  MISC_FEATURE (26)..(26): X is D and E for acidic amino acids
  MISC_FEATURE (27)..(27): X is D andE for acidic amino acids
  MISC_FEATURE (28)..(28): X is K, R or H for basic amino acids
  MISC_FEATURE (29)..(29): X is A and G
  MISC_FEATURE (30)..(30): X is A and G
  MISC_FEATURE (31)..(31): X is I, L or V
  MISC_FEATURE (32)..(32): X is I, L or V
  MISC_FEATURE (33)..(33): X is C or S
  MISC_FEATURE (34)..(34): X is T or S
  MISC_FEATURE (35)..(35): X is A or G
  MISC_FEATURE (36)..(36): X is I, L or V
  MISC_FEATURE (37)..(37): X is I, L or V

SEQ ID NO: 230 - protein, 32 aa, Artificial Sequence
  Completely synthesized peptide construct
SLKLMATLFSTYASGGGDGQEEKAGVVSTGLI

SEQ ID NO: 231 - protein, 32 aa, Artificial; identical to SEQ ID NO: 153
  peptide construct
  MISC_FEATURE (1)..(1): X is C or S
  MISC_FEATURE (2)..(2): X is I, L or V
  MISC_FEATURE (3)..(3): X is K, R or H for basic amino acids
  MISC_FEATURE (4)..(4): X is I, L or V
  MISC_FEATURE (5)..(5): X is M or Nle
  MISC_FEATURE (6)..(6): X is A or G
  MISC_FEATURE (7)..(7): X is T or S
  MISC_FEATURE (8)..(8): X is I, L or V
  MISC_FEATURE (9)..(9): X is F or P
  MISC_FEATURE (10)..(10): X is C or S
  MISC_FEATURE (11)..(11): X is T or S
  MISC_FEATURE (12)..(12): X is F, W or Y for aromatic amino acids
  MISC_FEATURE (13)..(13): X is A or G
  MISC_FEATURE (14)..(14): X is C or S
  MISC_FEATURE (15)..(15): X is A and G
  MISC_FEATURE (16)..(16): X is A or G
  MISC_FEATURE (17)..(17): X is A and G
  MISC_FEATURE (18)..(18): X is D and E for acidic amino acids
  MISC_FEATURE (19)..(19): X is A and G
  MISC_FEATURE (20)..(20): X is N or Q for amidated amino acids
  MISC_FEATURE (21)..(21): X is D and E for acidic amino acids
  MISC_FEATURE (22)..(22): X is D and E for acidic amino acids
  MISC_FEATURE (23)..(23): X is K, R or H for basic amino acids
  MISC_FEATURE (24)..(24): X is A and G
  MISC_FEATURE (25)..(25): X is A and G
  MISC_FEATURE (26)..(26): X is I, L or V
  MISC_FEATURE (27)..(27): X is I, L or V
  MISC_FEATURE (28)..(28): X is C or S
  MISC_FEATURE (29)..(29): X is T or S
  MISC_FEATURE (30)..(30): X is A and G
  MISC_FEATURE (31)..(31): X is I, L or V
  MISC_FEATURE (32)..(32): X is I, L or V

SEQ ID NO: 232 - protein, 32 aa, Artificial Sequence
  Completely synthesized peptide construct
SLKLMATLFSSYATGGGDGQEEKAGVVSTGLI

SEQ ID NO: 233 - protein, 32 aa, Artificial; identical to SEQ ID NO: 153
  peptide construct
  MISC_FEATURE (1)..(1): X is C or S
  MISC_FEATURE (2)..(2): X is I, L or V
  MISC_FEATURE (3)..(3): X is K, R or H for basic amino acids
  MISC_FEATURE (4)..(4): X is I, L or V
  MISC_FEATURE (5)..(5): X is M or Nle
  MISC_FEATURE (6)..(6): X is A or G
  MISC_FEATURE (7)..(7): X is T or S
  MISC_FEATURE (8)..(8): X is I, L or V
  MISC_FEATURE (9)..(9): X is F or P
  MISC_FEATURE (10)..(10): X is C or S
  MISC_FEATURE (11)..(11): X is C or S
  MISC_FEATURE (12)..(12): X is F, W or  Y for aromatic amino acids
  MISC_FEATURE (13)..(13): X is A or G
  MISC_FEATURE (14)..(14): X is T or S
  MISC_FEATURE (15)..(15): X is A and G
  MISC_FEATURE (16)..(16): X is A and G
  MISC_FEATURE (17)..(17): X is A or G
  MISC_FEATURE (18)..(18): X is D and E for acidic amino acids
  MISC_FEATURE (19)..(19): X is A and G
  MISC_FEATURE (20)..(20): X is N or Q for amidated amino acids
  MISC_FEATURE (21)..(21): X is D and E for acidic amino acids
  MISC_FEATURE (22)..(22): X is D and E for acidic amino acids
  MISC_FEATURE (23)..(23): X is K, R or H for basic amino acids
  MISC_FEATURE (24)..(24): X is A and G
  MISC_FEATURE (25)..(25): X is A and G
  MISC_FEATURE (26)..(26): X is I, L or V
  MISC_FEATURE (27)..(27): X is I, L or V
  MISC_FEATURE (28)..(28): X is C or S
  MISC_FEATURE (29)..(29): X is T or S
  MISC_FEATURE (30)..(30): X is A and G
  MISC_FEATURE (31)..(31): X is I, L or V
  MISC_FEATURE (32)..(32): X is I, L or V

SEQ ID NO: 234 - protein, 30 aa, Artificial
  Completely synthesized peptide construct
NITEAIADLTQKGGGDGQEEKAGVVSTGLI

SEQ ID NO: 235 - protein, 29 aa, Artificial
  peptide construct
  MISC_FEATURE (1)..(1): X is N or Q for amidated amino acids
  MISC_FEATURE (2)..(2): X is I, L or V
  MISC_FEATURE (3)..(3): X is T or S
  MISC_FEATURE (4)..(4): X is D and E for acidic amino acids
  MISC_FEATURE (5)..(5): X is I, L or V
  MISC_FEATURE (6)..(6): X is A or G
  MISC_FEATURE (7)..(7): X is D and E for acidic amino acids
  MISC_FEATURE (8)..(8): X is I, L or V
  MISC_FEATURE (9)..(9): X is  T or S
  MISC_FEATURE (10)..(10): X is N or Q for amidated amino acids
  MISC_FEATURE (11)..(11): X is K, R or H for basic amino acids
  MISC_FEATURE (12)..(12): X is A and G
  MISC_FEATURE (13)..(13): X is A or G
  MISC_FEATURE (14)..(14): X is A and G
  MISC_FEATURE (15)..(15): X is D and E for acidic amino acids
  MISC_FEATURE (16)..(16): X is A and G
  MISC_FEATURE (17)..(17): X is N or Q for amidated amino acids
  MISC_FEATURE (18)..(18): X is D and E for acidic amino acids
  MISC_FEATURE (19)..(19): X is D and E for acidic amino acids
  MISC_FEATURE (20)..(20): X is K, R or H for basic amino acids
  MISC_FEATURE (21)..(21): X is A and G
  MISC_FEATURE (22)..(22): X is A and G
  MISC_FEATURE (23)..(23): X is I, L or V
  MISC_FEATURE (24)..(24): X is I, L or V
  MISC_FEATURE (25)..(25): X is C or S
  MISC_FEATURE (26)..(26): X is T or S
  MISC_FEATURE (27)..(27): X is A and G
  MISC_FEATURE (28)..(28): X is I, L or V
  MISC_FEATURE (29)..(29): X is I, L or V
XXXXXXXXXXXXXXXXXXXXXXXXXXXXX

SEQ ID NO: 236 - protein, 58 aa, Artificial
  Completely synthesized peptide construct
NMYAMMIARFKMFPEVKEKGMAALPRLIAFTSEHSHFSLKGGGDGQEEKAGVVSTGLI

SEQ ID NO: 237 - protein, 58 aa, Artificial; identical to SEQ ID NO: 135
  peptide construct
  MISC_FEATURE (1)..(1): X is N or Q for amidated amino acids
  MISC_FEATURE (2)..(2): X is M or Nle
  MISC_FEATURE (3)..(3): X is F, W or Y for aromatic amino acids
  MISC_FEATURE (4)..(4): X is A or G
  MISC_FEATURE (5)..(5): X is M or Nle
  MISC_FEATURE (6)..(6): Xis M or Nle
  MISC_FEATURE (7)..(7): X is I, L or V
  MISC_FEATURE (8)..(8): X is A or G
  MISC_FEATURE (9)..(9): X is K, R or H for basic amino acids
  MISC_FEATURE (10)..(10): X is F, W or Y for aromatic amino acids
  MISC_FEATURE (11)..(11): X is K, R or H for basic amino acids
  MISC_FEATURE (12)..(12): X is M or Nle
  MISC_FEATURE (13)..(13): X is F, W or Y for aromatic amino acids
  MISC_FEATURE (14)..(14): X is F or P
  MISC_FEATURE (15)..(15): X is D and E for acidic amino acids
  MISC_FEATURE (16)..(16): X is I, L or V
  MISC_FEATURE (17)..(17): X is K, R or H for basic amino acids
  MISC_FEATURE (18)..(18): X is D and E for acidic amino acids
  MISC_FEATURE (19)..(19): X is K, R or H for basic amino acids
  MISC_FEATURE (20)..(20): X is A or G
  MISC_FEATURE (21)..(21): X is M or Nle
  MISC_FEATURE (22)..(22): X is A or G
  MISC_FEATURE (23)..(23): X is A or G
  MISC_FEATURE (24)..(24): X is I, L or V
  MISC_FEATURE (25)..(25): X is F or P
  MISC_FEATURE (26)..(26): X is K, R or H for basic amino acids
  MISC_FEATURE (27)..(27): X is I, L or V
  MISC_FEATURE (28)..(28): X is I, L or V
  MISC_FEATURE (29)..(29): X is A or G
  MISC_FEATURE (30)..(30): X is F, W or  Y for aromatic amino acids
  MISC_FEATURE (31)..(31): X is T or S
  MISC_FEATURE (32)..(32): X is C or S
  MISC_FEATURE (33)..(33): X is D and E for acidic amino acids
  MISC_FEATURE (34)..(34): X is K, R or H for basic amino acids
  MISC_FEATURE (35)..(35): X is C or S
  MISC_FEATURE (36)..(36): X is K, R or H for basic amino acids
  MISC_FEATURE (37)..(37): X is F, W or Y aromatic amino acids
  MISC_FEATURE (38)..(38): X is C or S
  MISC_FEATURE (39)..(39): X is I, L or V
  MISC_FEATURE (40)..(40): X is K, R or H for basic amino acids
  MISC_FEATURE (41)..(41): X is A and G
  MISC_FEATURE (42)..(42): X is A or G
  MISC_FEATURE (43)..(43): X is A and G
  MISC_FEATURE (44)..(44): X is D and E for acidic amino acids
  MISC_FEATURE (45)..(45): X is A and G
  MISC_FEATURE (46)..(46): X is N or Q for amidated amino acids
  MISC_FEATURE (47)..(47): X is D and E for acidic amino acids
  MISC_FEATURE (48)..(48): X is D and E for acidic amino acids
  MISC_FEATURE (49)..(49): X is K, R or H for basic amino acids
  MISC_FEATURE (50)..(50): X is A and G
  MISC_FEATURE (51)..(51): X is A and G
  MISC_FEATURE (52)..(52): X is I, L or V
  MISC_FEATURE (53)..(53): X is I, L or V
  MISC_FEATURE (54)..(54): X is C or S
  MISC_FEATURE (55)..(55): X is T or S
  MISC_FEATURE (56)..(56): X is A or G
  MISC_FEATURE (57)..(57): X is I, L or V
  MISC_FEATURE (58)..(58): X is I, L or V

SEQ ID NO: 238 - protein, 52 aa, Artificial
  Completely synthesized peptide construct
IARFKMFPEVKEKGMAALPRLIAFTSEHSHFSLKGGGDGQEEKAGVVSTGLI

SEQ ID NO: 239 - protein, 52 aa, Artificial; identical to SEQ ID NO: 160
  peptide construct
  MISC_FEATURE (1)..(1): X is I, L or V
  MISC_FEATURE (2)..(2): X is A or G
  MISC_FEATURE (3)..(3): X is K, R or H for basic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is M or Nle
  MISC_FEATURE (7)..(7): X is F, W or Y for aromatic amino acids
  MISC_FEATURE (8)..(8): X is F or P
  MISC_FEATURE (9)..(9): X is D and E for acidic amino acids
  MISC_FEATURE (10)..(10): X is I, L or V
  MISC_FEATURE (11)..(11): X is K, R or H for basic amino acids
  MISC_FEATURE (12)..(12): X is D and E for acidic amino acids
  MISC_FEATURE (13)..(13): X is K, R or H for basic amino acids
  MISC_FEATURE (14)..(14): X is A or G
  MISC_FEATURE (15)..(15): X is M or Nle
  MISC_FEATURE (16)..(16): X is A or G
  MISC_FEATURE (17)..(17): X is A or G
  MISC_FEATURE (18)..(18): X is I, L or V
  MISC_FEATURE (19)..(19): X is F or P
  MISC_FEATURE (20)..(20): X is K,  R or H for basic amino acids
  MISC_FEATURE (21)..(21): X is I, L or V
  MISC_FEATURE (22)..(22): X is I, L or V
  MISC_FEATURE (23)..(23): X is A or G
  MISC_FEATURE (24)..(24): X is F, W or Y for aromatic amino acids
  MISC_FEATURE (25)..(25): X is T or S
  MISC_FEATURE (26)..(26): X is C or S
  MISC_FEATURE (27)..(27): X is D and E for acidic amino acids
  MISC_FEATURE (28)..(28): X is K, R or H for basic amino acids
  MISC_FEATURE (29)..(29): X is C or S
  MISC_FEATURE (30)..(30): X is K, R or H for basic amino acids
  MISC_FEATURE (31)..(31): X is F, W or Y for aromatic amino acids
  MISC_FEATURE (32)..(32): X is C or S
  MISC_FEATURE (33)..(33): X is I, L or V
  MISC_FEATURE (34)..(34): X is K, R or H for basic amino acids
  MISC_FEATURE (35)..(35): X is A and G
  MISC_FEATURE (36)..(36): X is A or G
  MISC_FEATURE (37)..(37): X is A and G
  MISC_FEATURE (38)..(38): X is D and E for acidic amino acids
  MISC_FEATURE (39)..(39): X is A and G
  MISC_FEATURE (40)..(40): X is N or Q for amidated amino acids
  MISC_FEATURE (41)..(41): X is  D and E for acidic amino acids
  MISC_FEATURE (42)..(42): X is D and E for acidic amino acids
  MISC_FEATURE (43)..(43): X is K, R or H for basic amino acids
  MISC_FEATURE (44)..(44): X is A and G
  MISC_FEATURE (45)..(45): X is A and G
  MISC_FEATURE (46)..(46): X is I, L or V
  MISC_FEATURE (47)..(47): X is I, L or V
  MISC_FEATURE (48)..(48): X is C or S
  MISC_FEATURE (49)..(49): X is T or S
  MISC_FEATURE (50)..(50): X is A and G
  MISC_FEATURE (51)..(51): X is I, L or V
  MISC_FEATURE (52)..(52): X is I, L or V

SEQ ID NO: 240 - protein, 37 aa, Artificial
  Completely synthesized peptide construct
SRLSKVAPVIKARMMEYGTTGGDGQEEKAGVVSTGLI

SEQ ID NO: 241 - protein, 38 aa, Artificial; identical to SEQ ID NO: 162
  peptide construct
  MISC_FEATURE (1)..(1): X is C or S
  MISC_FEATURE (2)..(2): X is K, R or H for basic amino acids
  MISC_FEATURE (3)..(3): X is I, L or V
  MISC_FEATURE (4)..(4): X is C or S
  MISC_FEATURE (5)..(5): X is K, R or H for basic amino acids
  MISC_FEATURE (6)..(6): X is I, L or V
  MISC_FEATURE (7)..(7): X is A or G
  MISC_FEATURE (8)..(8): X is F or  P
  MISC_FEATURE (9)..(9): X is I, L or V
  MISC_FEATURE (10)..(10): X is I, L or V
  MISC_FEATURE (11)..(11): X is K, R or H for basic amino acids
  MISC_FEATURE (12)..(12): X is A or  G
  MISC_FEATURE (13)..(13): X is K, R or H for basic amino acids
  MISC_FEATURE (14)..(14): X is M or Nle
  MISC_FEATURE (15)..(15): X is M or Nle
  MISC_FEATURE (16)..(16): X is D and E for acidic amino acids
  MISC_FEATURE (17)..(17): X is F, W or Y for acidic amino acids
  MISC_FEATURE (18)..(18): X is A or G
  MISC_FEATURE (19)..(19): X is T or S
  MISC_FEATURE (20)..(20): X is T or S
  MISC_FEATURE (21)..(21): X is A and G
  MISC_FEATURE (22)..(22): X is A or  G
  MISC_FEATURE (23)..(23): X is A and G
  MISC_FEATURE (24)..(24): X is D and E for acidic amino acids
  MISC_FEATURE (25)..(25): X is A and G
  MISC_FEATURE (26)..(26): X is N or Q for amidated amino acids
  MISC_FEATURE (27)..(27): X is D and E for acidic amino acids
  MISC_FEATURE (28)..(28): X is D and E for acidic amino acids
  MISC_FEATURE (29)..(29): X is K, R or H for basic amino acids
  MISC_FEATURE (30)..(30): X is A and G
  MISC_FEATURE (31)..(31): X is A and G
  MISC_FEATURE (32)..(32): X is I, L or V
  MISC_FEATURE (33)..(33): X is I, L or V
  MISC_FEATURE (34)..(34): X is C or S
  MISC_FEATURE (35)..(35): X is T or S
  MISC_FEATURE (36)..(36): X is A and G
  MISC_FEATURE (37)..(37): X is I, L or V
  MISC_FEATURE (38)..(38): X is I, L or V

SEQ ID NO: 242 - protein, 37 aa, Artificial
  Completely synthesized peptide construct
IPPSLRYLEDEERMSRLSKGGGDGQEEKAGVVSTGLI

SEQ ID NO: 243 - protein, 36 aa, Artificial; identical to SEQ ID NO: 164
  peptide construct
  MISC_FEATURE (1)..(1): X is I, L or V
  MISC_FEATURE (2)..(2): X is F or P
  MISC_FEATURE (3)..(3): X is F or P
  MISC_FEATURE (4)..(4): X is C or S
  MISC_FEATURE (5)..(5): X is I, L or V
  MISC_FEATURE (6)..(6): X is K, R or H for basic amino acids
  MISC_FEATURE (7)..(7): X is F, W or Y for aromatic amino acids
  MISC_FEATURE (8)..(8): X is D and E for acidic amino acids
  MISC_FEATURE (9)..(9): X is D and E for acidic amino acids
  MISC_FEATURE (10)..(10): X is D and E for acidic amino acids
  MISC_FEATURE (11)..(11): X is D and E for acidic amino acids
  MISC_FEATURE (12)..(12): X is K, R or H for basic amino acids
  MISC_FEATURE (13)..(13): X is M or Nle
  MISC_FEATURE (14)..(14): X is C or S
  MISC_FEATURE (15)..(15): X is K, R or H for basic amino acids
  MISC_FEATURE (16)..(16): X is I, L or V
  MISC_FEATURE (17)..(17): X is C or S
  MISC_FEATURE (18)..(18): X is K, R or H for basic amino acids
  MISC_FEATURE (19)..(19): X is A and G
  MISC_FEATURE (20)..(20): X is A or G
  MISC_FEATURE (21)..(21): X is A and G
  MISC_FEATURE (22)..(22): X is D and E for acidic amino acids
  MISC_FEATURE (23)..(23): X is A and G
  MISC_FEATURE (24)..(24): X is N or Q for amidated amino acids
  MISC_FEATURE (25)..(25): X is D and E for acidic amino acids
  MISC_FEATURE (26)..(26): X is D and E for acidic amino acids
  MISC_FEATURE (27)..(27): X is K, R or H for basic amino acids
  MISC_FEATURE (28)..(28): X is A and G
  MISC_FEATURE (29)..(29): X is A and G
  MISC_FEATURE (30)..(30): X is I, L or V
  MISC_FEATURE (31)..(31): X is I, L or V
  MISC_FEATURE (32)..(32): X is C or S
  MISC_FEATURE (33)..(33): X is T or S
  MISC_FEATURE (34)..(34): X is A or G
  MISC_FEATURE (35)..(35): X is I, L or V
  MISC_FEATURE (36)..(36): X is I, L or V

SEQ ID NO: 244 - protein, 38 aa, Artificial
  Completely synthesized peptide construct
NTNMFTYEIAPVFVLLEYVTGGGDGQEEKAGVVSTGLI

SEQ ID NO: 245 - protein, 38 aa, Artificial; identical to SEQ ID NO: 162
  peptide construct
  MISC_FEATURE (1)..(1): X is N or Q for amidated amino acids
  MISC_FEATURE (2)..(2): X is T or S
  MISC_FEATURE (3)..(3): X is N or Q for amidated amino acids
  MISC_FEATURE (4)..(4): X is M or Nle
  MISC_FEATURE (5)..(5): X is F, W or Y for aromatic amino acids
  MISC_FEATURE (6)..(6): X is T or S
  MISC_FEATURE (7)..(7): X is F, W or Y for aromatic amino acids
  MISC_FEATURE (8)..(8): X is D and E for acidic amino acids
  MISC_FEATURE (9)..(9): X is I, L or V
  MISC_FEATURE (10)..(10): X is A or G
  MISC_FEATURE (11)..(11): X is F or P
  MISC_FEATURE (12)..(12): X is I, L or V
  MISC_FEATURE (13)..(13): X is F, W or Y for aromatic amino acids
  MISC_FEATURE (14)..(14): X is I, L or V
  MISC_FEATURE (15)..(15): X is I, L or V
  MISC_FEATURE (16)..(16): X is I, L or V
  MISC_FEATURE (17)..(17): X is D and E for acidic amino acids
  MISC_FEATURE (18)..(18): X is F, W or Y for aromatic amino acids
  MISC_FEATURE (19)..(19): X is I, L or V
  MISC_FEATURE (20)..(20): X is T or S
  MISC_FEATURE (21)..(21): X is A and G
  MISC_FEATURE (22)..(22): X is A or G
  MISC_FEATURE (23)..(23): X is A and G
  MISC_FEATURE (24)..(24): X is D and E for acidic amino acids
  MISC_FEATURE (25)..(25): X is A and G
  MISC_FEATURE (26)..(26): X is N or Q for amidated amino acids
  MISC_FEATURE (27)..(27): X is D and E for acidic amino acids
  MISC_FEATURE (28)..(28): X is D and E for acidic amino acids
  MISC_FEATURE (29)..(29): X is K, R or H for basic amino acids
  MISC_FEATURE (30)..(30): X is A and G
  MISC_FEATURE (31)..(31): X is A and G
  MISC_FEATURE (32)..(32): X is I, L or V
  MISC_FEATURE (33)..(33): X is I, L or V
  MISC_FEATURE (34)..(34): X is C or S
  MISC_FEATURE (35)..(35): X is T or C
  MISC_FEATURE (36)..(36): X is A or G
  MISC_FEATURE (37)..(37): X is I, L or V
  MISC_FEATURE (38)..(38): X is I, L or V

SEQ ID NO: 246 - protein, 33 aa, Artificial
  Completely synthesized peptide construct
FKADEKKFWGKYLYEGGGDGQEEKAGVVSTGLI

SEQ ID NO: 247 - protein, 33 aa, Artificial; identical to SEQ ID NO: 97
  peptide construct
  MISC_FEATURE (1)..(1): X is F, W or Y for aromatic amino acids
  MISC_FEATURE (2)..(2): X is K, R or H for basic amino acids
  MISC_FEATURE (3)..(3): X is A or G
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is K, R or H for basic amino acids
  MISC_FEATURE (8)..(8): X is F, W or Y for aromatic amino acids
  MISC_FEATURE (9)..(9): X is F, W or Y for aromatic amino acids
  MISC_FEATURE (10)..(10): X is A or G
  MISC_FEATURE (11)..(11): X is K, R or H for basic amino acids
  MISC_FEATURE (12)..(12): X is F, W or Y for aromatic amino acids
  MISC_FEATURE (13)..(13): X is I, L or V
  MISC_FEATURE (14)..(14): X is F, W or Y for aromatic amino acids
  MISC_FEATURE (15)..(15): X is D and E for acidic amino acids
  MISC_FEATURE (16)..(16): X is A and G
  MISC_FEATURE (17)..(17): X is A or G
  MISC_FEATURE (18)..(18): X is A and G
  MISC_FEATURE (19)..(19): X is D and E for acidic amino acids
  MISC_FEATURE (20)..(20): X is A and G
  MISC_FEATURE (21)..(21): X is N or Q for amidated amino acids
  MISC_FEATURE (22)..(22): X is D and E for acidic amino acids
  MISC_FEATURE (23)..(23): X is D and E for acidic amino acids
  MISC_FEATURE (24)..(24): X is K, R or H for basic amino acids
  MISC_FEATURE (25)..(25): X is A and G
  MISC_FEATURE (26)..(26): X is A and G
  MISC_FEATURE (27)..(27): X is I, L or V
  MISC_FEATURE (28)..(28): X is I, L or V
  MISC_FEATURE (29)..(29): X is C or S
  MISC_FEATURE (30)..(30): X is T or S
  misc_feature (31)..(31): Xaa can be any naturally occurring amino acid
  MISC_FEATURE (32)..(32): X is A and G
  MISC_FEATURE (32)..(32): X is I, L or V
  MISC_FEATURE (33)..(33): X is I, L or V

SEQ ID NO: 248 - protein, 33 aa, Artificial
  Completely synthesized peptide construct
SHLVEALYLVCGERGGGGDGQEEKAGVVSTGLI

SEQ ID NO: 249 - protein, 32 aa, Artificial; identical to SEQ ID NO: 153
  peptide construct
  MISC_FEATURE (1)..(1): X is C or S
  MISC_FEATURE (2)..(2): X is K, R or H for basic amino acids
  MISC_FEATURE (3)..(3): X is I, L or V
  MISC_FEATURE (4)..(4): X is I, L or V
  MISC_FEATURE (5)..(5): X is D and E for acidic amino acids
  MISC_FEATURE (6)..(6): X is A or G
  MISC_FEATURE (7)..(7): X is I, L or V
  MISC_FEATURE (8)..(8): X is F, W or Y for aromatic amino acids
  MISC_FEATURE (9)..(9): X is I, L or V
  MISC_FEATURE (10)..(10): X is C or S
  MISC_FEATURE (11)..(11): X is A or G
  MISC_FEATURE (12)..(12): X is D and E for acidic amino acids
  MISC_FEATURE (13)..(13): X is K, R or H for basic amino acids
  MISC_FEATURE (14)..(14): X is A or G
  MISC_FEATURE (15)..(15): X is A and G
  MISC_FEATURE (16)..(16): X is A or G
  MISC_FEATURE (17)..(17): X is A and G
  MISC_FEATURE (18)..(18): X is D and E for acidic amino acids
  MISC_FEATURE (19)..(19): X is A and G
  MISC_FEATURE (20)..(20): X is N or Q for amidated amino acids
  MISC_FEATURE (21)..(21): X is D and E for acidic amino acids
  MISC_FEATURE (22)..(22): X is D and E for acidic amino acids
  MISC_FEATURE (23)..(23): X is K, R or H for basic amino acids
  MISC_FEATURE (24)..(24): X is A and G
  MISC_FEATURE (25)..(25): X is A and G
  MISC_FEATURE (26)..(26): X is I, L or V
  MISC_FEATURE (27)..(27): X is I, L or V
  MISC_FEATURE (28)..(28): X is C or S
  MISC_FEATURE (29)..(29): X is T or S
  MISC_FEATURE (30)..(30): X is A and G
  MISC_FEATURE (31)..(31): X is I, L or V
  MISC_FEATURE (32)..(32): X is I, L or V

SEQ ID NO: 250 - protein, 42 aa, Artificial
  Completely synthesized peptide construct
VLGGGCALLRCIPALDSLTPANEDGGGDGQEEKAGVVSTGLI

SEQ ID NO: 251 - protein, 42 aa, Artificial; identical to SEQ ID NO: 172
  peptide construct
  MISC_FEATURE (1)..(1): X is I, L or V
  MISC_FEATURE (2)..(2): X is I, L or V
  MISC_FEATURE (3)..(3): X is A or G
  MISC_FEATURE (4)..(4): X is A or G
  MISC_FEATURE (5)..(5): X is A or G
  MISC_FEATURE (6)..(6): X is C or S
  MISC_FEATURE (7)..(7): X is A or G
  MISC_FEATURE (8)..(8): X is I, L or V
  MISC_FEATURE (9)..(9): X is I, L or V
  MISC_FEATURE (10)..(10): X is K, R or H for basic amino acids
  MISC_FEATURE (11)..(11): X is C or S
  MISC_FEATURE (12)..(12): X is I, L or V
  MISC_FEATURE (13)..(13): X is F or P
  MISC_FEATURE (14)..(14): X is A or G
  MISC_FEATURE (15)..(15): X is I, L or V
  MISC_FEATURE (16)..(16): X is D and E for acidic amino acids
  MISC_FEATURE (17)..(17): X is C or S
  MISC_FEATURE (18)..(18): X is I, L or V
  MISC_FEATURE (19)..(19): X is T or S
  MISC_FEATURE (20)..(20): X is F or P
  MISC_FEATURE (21)..(21): X is A or G
  MISC_FEATURE (22)..(22): X is N or Q for amidated amino acids
  MISC_FEATURE (23)..(23): X is D and E for acidic amino acids
  MISC_FEATURE (24)..(24): X is D and E for acidic amino acids
  MISC_FEATURE (25)..(25): X is A and G
  MISC_FEATURE (26)..(26): X is A or G
  MISC_FEATURE (27)..(27): X is A and G
  MISC_FEATURE (28)..(28): X is D and E for acidic amino acids
  MISC_FEATURE (29)..(29): X is A and G
  MISC_FEATURE (30)..(30): X is N or Q for amidated amino acids
  MISC_FEATURE (31)..(31): X is D and E for acidic amino acids
  MISC_FEATURE (32)..(32): X is D and E for acidic amino acids
  MISC_FEATURE (33)..(33): X is K, R or H for basic amino acids
  MISC_FEATURE (34)..(34): X is A and G
  MISC_FEATURE (35)..(35): X is A and G
  MISC_FEATURE (36)..(36): X is I, L or V
  MISC_FEATURE (37)..(37): X is I, L or V
  MISC_FEATURE (38)..(38): X is C or S
  MISC_FEATURE (39)..(39): X is T or S
  MISC_FEATURE (40)..(40): X is A or G
  MISC_FEATURE (41)..(41): X is I, L or V
  MISC_FEATURE (42)..(42): X is I, L or V

SEQ ID NO: 252 - protein, 46 aa, Artificial
  Completely synthesized peptide construct
EACVTSWLWSGEGAVFYRVDLHFINLGTGGGDGQEEKAGVVSTGLI

SEQ ID NO: 253 - protein, 46 aa, Artificial; identical to SEQ ID NO: 137
  peptide construct
  MISC_FEATURE (1)..(1): X is D and E for acidic amino acids
  MISC_FEATURE (2)..(2): X is  A or G
  MISC_FEATURE (3)..(3): X is C or S
  MISC_FEATURE (4)..(4): X is I, L or V
  MISC_FEATURE (5)..(5): X is T or S
  MISC_FEATURE (6)..(6): X is C or S
  MISC_FEATURE (7)..(7): X is F, W or Y for aromatic amino acids
  MISC_FEATURE (8)..(8): X is I, L or V
  MISC_FEATURE (9)..(9): X is F, W or Y for aromatic amino acids
  MISC_FEATURE (10)..(10): X is C or S
  MISC_FEATURE (11)..(11): X is A or  G
  MISC_FEATURE (12)..(12): X is D and E for acidic amino acids
  MISC_FEATURE (13)..(13): X is A or G
  MISC_FEATURE (14)..(14): X is A or G
  MISC_FEATURE (15)..(15): X is I, L or V
  MISC_FEATURE (16)..(16): X is F, W or Y for aromatic amino acids
  MISC_FEATURE (17)..(17): X is F, W or Y for aromatic amino acids
  MISC_FEATURE (18)..(18): X is K, R or H for basic amino acids
  MISC_FEATURE (19)..(19): X is I, L or V
  MISC_FEATURE (20)..(20): X is D and E for acidic amino acids
  MISC_FEATURE (21)..(21): X is I, L or V
  MISC_FEATURE (22)..(22): X is K, R or H for basic amino acids
  MISC_FEATURE (23)..(23): X is F, W or Y for aromatic amino acids
  MISC_FEATURE (24)..(24): X is I, L or V
  MISC_FEATURE (25)..(25): X is N or Q for amidated amino acids
  MISC_FEATURE (26)..(26): X is I, L or V
  MISC_FEATURE (27)..(27): X is A or G
  MISC_FEATURE (28)..(28): X is T or S
  MISC_FEATURE (29)..(29): X is A and G
  MISC_FEATURE (30)..(30): X is A or G
  MISC_FEATURE (31)..(31): X is A or G
  MISC_FEATURE (32)..(32): X is D and E for acidic amino acids
  MISC_FEATURE (33)..(33): X is A and G
  MISC_FEATURE (34)..(34): X is N or Q for amidated amino acids
  MISC_FEATURE (35)..(35): X is D and E for acidic amino acids
  MISC_FEATURE (36)..(36): X is D and E for acidic amino acids
  MISC_FEATURE (37)..(37): X is K, R or H for basic amino acids
  MISC_FEATURE (38)..(38): X is A and G
  MISC_FEATURE (39)..(39): X is A and G
  MISC_FEATURE (40)..(40): X is I, L or V
  MISC_FEATURE (41)..(41): X is I, L or V
  MISC_FEATURE (42)..(42): X is C or S
  MISC_FEATURE (43)..(43): X is T or S
  MISC_FEATURE (44)..(44): X is A and G
  MISC_FEATURE (45)..(45): X is I, L or V
  MISC_FEATURE (46)..(46): X is I, L or V

SEQ ID NO: 254 - protein, 39 aa, Artificial
  Completely synthesized peptide construct
MDFWCVEHDRPPPATPTSLTTGGGDGQEEKAGVVSTGLI

SEQ ID NO: 255 - protein, 39 aa, Artificial; identical to SEQ ID NO: 176
  peptide construct
  MISC_FEATURE (1)..(1): X is M or Nle
  MISC_FEATURE (2)..(2): X is D and E for acidic amino acids
  MISC_FEATURE (3)..(3): X is F, W or Y for aromatic amino acids
  MISC_FEATURE (4)..(4): X is F, W or Y for aromatic amino acids
  MISC_FEATURE (5)..(5): X is C or S
  MISC_FEATURE (6)..(6): X is I, L or V
  MISC_FEATURE (7)..(7): X is D and E for acidic amino acids
  MISC_FEATURE (8)..(8): X is K, R or H for basic amino acids
  MISC_FEATURE (9)..(9): X is D and E for acidic amino acids
  MISC_FEATURE (10)..(10): X is K, R or H for basic amino acids
  MISC_FEATURE (11)..(11): X is F or P
  MISC_FEATURE (12)..(12): X is F or P
  MISC_FEATURE (13)..(13): X is F or P
  MISC_FEATURE (14)..(14): X is A or G
  MISC_FEATURE (15)..(15): X is T or S
  MISC_FEATURE (16)..(16): X is F or P
  MISC_FEATURE (17)..(17): X is T or S
  MISC_FEATURE (18)..(18): X is C or S
  MISC_FEATURE (19)..(19): X is I, L or V
  MISC_FEATURE (20)..(20): X is T or S
  MISC_FEATURE (21)..(21): X is T or S
  MISC_FEATURE (22)..(22): X is A and G
  MISC_FEATURE (23)..(23): X is A or G
  MISC_FEATURE (24)..(24): X is A and G
  MISC_FEATURE (25)..(25): X is D and E for acidic amino acids
  MISC_FEATURE (26)..(26): X is A and G
  MISC_FEATURE (27)..(27): X is N or Q for amidated amino acids
  MISC_FEATURE (28)..(28): X is D and E for acidic amino acids
  MISC_FEATURE (29)..(29): X is D and E for acidic amino acids
  MISC_FEATURE (30)..(30): X is K, R or H for basic amino acids
  MISC_FEATURE (31)..(31): X is A and G
  MISC_FEATURE (32)..(32): X is A and G
  MISC_FEATURE (33)..(33): X is I, L or V
  MISC_FEATURE (34)..(34): X is I, L or V
  MISC_FEATURE (35)..(35): X is C or S
  MISC_FEATURE (36)..(36): X is T or S
  MISC_FEATURE (37)..(37): X is A and G
  MISC_FEATURE (38)..(38): X is I, L or V
  MISC_FEATURE (39)..(39): X is I, L or V

SEQ ID NO: 256 - protein, 38 aa, Artificial
  Completely synthesized peptide construct
NMYAMMIARFKMFPEVKEKGGGGDGQEEKAGVVSTGLI

SEQ ID NO: 257 - protein, 38 aa, Artificial; identical to SEQ ID NO: 162
  peptide construct
  MISC_FEATURE (1)..(1): X is N or Q for amidated amino acids
  MISC_FEATURE (2)..(2): X is M or Nle
  MISC_FEATURE (3)..(3): X is F, W or Y for aromatic amino acids
  MISC_FEATURE (4)..(4): X is A or G
  MISC_FEATURE (5)..(5): X is M or Nle
  MISC_FEATURE (6)..(6): X is M or Nle
  MISC_FEATURE (7)..(7): X is I, L or V
  MISC_FEATURE (8)..(8): X is A or G
  MISC_FEATURE (9)..(9): X is K, R or H for basic amino acids
  MISC_FEATURE (10)..(10): X is F, W or Y for aromatic amino acids
  MISC_FEATURE (11)..(11): X is K, R or H for basic amino acids
  MISC_FEATURE (12)..(12): X is M or Nle
  MISC_FEATURE (13)..(13): X is F, W or Y for aromatic amino acids
  MISC_FEATURE (14)..(14): X is F or P
  MISC_FEATURE (15)..(15): X is D and E for acidic amino acids
  MISC_FEATURE (16)..(16): X is I, L or V
  MISC_FEATURE (17)..(17): X is K, R or H for basic amino acids
  MISC_FEATURE (18)..(18): X is D and E for acidic amino acids
  MISC_FEATURE (19)..(19): X is K, R or H for basic amino acids
  MISC_FEATURE (20)..(20): X is A or G
  MISC_FEATURE (21)..(21): X is A and G
  MISC_FEATURE (22)..(22): X is A or G
  MISC_FEATURE (23)..(23): X is A and G
  MISC_FEATURE (24)..(24): X is D and E for acidic amino acids
  MISC_FEATURE (25)..(25): X is A and G
  MISC_FEATURE (26)..(26): X is N or Q for amidated amino acids
  MISC_FEATURE (27)..(27): X is D and E for acidic amino acids
  MISC_FEATURE (28)..(28): X is D and E for acidic amino acids
  MISC_FEATURE (29)..(29): X is K, R or H for basic amino acids
  MISC_FEATURE (30)..(30): X is A and G
  MISC_FEATURE (31)..(31): X is A and G
  MISC_FEATURE (32)..(32): X is I, L or V
  MISC_FEATURE (33)..(33): X is I, L or V
  MISC_FEATURE (34)..(34): X is C or S
  MISC_FEATURE (35)..(35): X is T or S
  MISC_FEATURE (36)..(36): X is A or G
  MISC_FEATURE (37)..(37): X is I, L or V
  MISC_FEATURE (38)..(38): X is I, L or V

SEQ ID NO: 258 - protein, 51 aa, Artificial
  Completely synthesized peptide construct
NMYAMMIARFKMFPEVKEKGMAALPRLIAFTSEGGGDGQEEKAGVVSTGLI

SEQ ID NO: 259 - protein, 51 aa, Artificial; identical to SEQ ID NO: 180
  peptide construct
  MISC_FEATURE (1)..(1): X is N or Q for amidated amino acids
  MISC_FEATURE (2)..(2): X is M or Nle
  MISC_FEATURE (3)..(3): X is F, W or Y for aromatic amino acids
  MISC_FEATURE (4)..(4): X is A or G
  MISC_FEATURE (5)..(5): X is M or Nle
  MISC_FEATURE (6)..(6): X is M or Nle
  MISC_FEATURE (7)..(7): X is I, L or V
  MISC_FEATURE (8)..(8): X is A or G
  MISC_FEATURE (9)..(9): X is K, R or H for basic amino acids
  MISC_FEATURE (10)..(10): X is F, W or Y for aromatic amino acids
  MISC_FEATURE (11)..(11): X is K, R or H for basic amino acids
  MISC_FEATURE (12)..(12): X is M or Nle
  MISC_FEATURE (13)..(13): X is F, W or Y for aromatic amino acids
  MISC_FEATURE (14)..(14): X is F or P
  MISC_FEATURE (15)..(15): X is D and E for acidic amino acids
  MISC_FEATURE (16)..(16): X is I, L or V
  MISC_FEATURE (17)..(17): X is K, R or H for basic amino acids
  MISC_FEATURE (18)..(18): X is D and E for acidic amino acids
  MISC_FEATURE (19)..(19): X is K, R or H for basic amino acids
  MISC_FEATURE (20)..(20): X is A or G
  MISC_FEATURE (21)..(21): X is M or Nle
  MISC_FEATURE (22)..(22): X is A or G
  MISC_FEATURE (23)..(23): X is A or G
  MISC_FEATURE (24)..(24): X is I, L or V
  MISC_FEATURE (25)..(25): X is F or P
  MISC_FEATURE (26)..(26): X is K, R or H for basic amino acids
  MISC_FEATURE (27)..(27): X is I, L or V
  MISC_FEATURE (28)..(28): X is I, L or V
  MISC_FEATURE (29)..(29): X is A or G
  MISC_FEATURE (30)..(30): X is F, W or Y for aromatic amino acids
  MISC_FEATURE (31)..(31): X is T or S
  MISC_FEATURE (32)..(32): X is C or S
  MISC_FEATURE (33)..(33): X is D and E for acidic amino acids
  MISC_FEATURE (34)..(34): X is A and G
  MISC_FEATURE (35)..(35): X is A or G
  MISC_FEATURE (36)..(36): X is A and G
  MISC_FEATURE (37)..(37): X is D and E for acidic amino acids
  MISC_FEATURE (38)..(38): X is A and G
  MISC_FEATURE (39)..(39): X is N or Q for amidated amino acids
  MISC_FEATURE (40)..(40): X is D and E for acidic amino acids
  MISC_FEATURE (41)..(41): X is D and E for acidic amino acids
  MISC_FEATURE (42)..(42): X is K, R or H for basic amino acids
  MISC_FEATURE (43)..(43): X is A and G
  MISC_FEATURE (44)..(44): X is A and G
  MISC_FEATURE (45)..(45): X is I, L or V
  MISC_FEATURE (46)..(46): X is I, L or V
  MISC_FEATURE (47)..(47): X is C or S
  MISC_FEATURE (48)..(48): X is T or S
  MISC_FEATURE (49)..(49): X is A and G
  MISC_FEATURE (50)..(50): X is I, L or V
  MISC_FEATURE (51)..(51): X is I, L or V

SEQ ID NO: 260 - protein, 31 aa, Artificial
  Completely synthesized peptide construct
IAFTSEHSHFSLKGGGDGQEEKAGVVSTGLI

SEQ ID NO: 261 - protein, 31 aa, Artificial; identical to SEQ ID NO: 123
  peptide construct
  MISC_FEATURE (1)..(1): X is I, L or V
  MISC_FEATURE (2)..(2): X is A or G
  MISC_FEATURE (3)..(3): X is F, W or Y for aromatic amino acids
  MISC_FEATURE (4)..(4): X is T or S
  MISC_FEATURE (5)..(5): X is C or S
  MISC_FEATURE (6)..(6): X is D and E for acidic amino acids
  MISC_FEATURE (7)..(7): X is K, R or H for basic amino acids
  MISC_FEATURE (8)..(8): X is C or S
  MISC_FEATURE (9)..(9): X is K, R or H for basic amino acids
  MISC_FEATURE (10)..(10): X is F, W or Y for aromatic amino acids
  MISC_FEATURE (11)..(11): X is C or S
  MISC_FEATURE (12)..(12): X is I, L or V
  MISC_FEATURE (13)..(13): X is K, R or H for basic amino acids
  MISC_FEATURE (14)..(14): X is A and G
  MISC_FEATURE (15)..(15): X is A or G
  MISC_FEATURE (16)..(16): X is A and G
  MISC_FEATURE (17)..(17): X is D and E for acidic amino acids
  MISC_FEATURE (18)..(18): X is A and G
  MISC_FEATURE (19)..(19): X is N or Q for amidated amino acids
  MISC_FEATURE (20)..(20): X is D or E for acidic amino acids
  MISC_FEATURE (21)..(21): X is D and E for acidic amino acids
  MISC_FEATURE (22)..(22): X is K, R or H for basic amino acids
  MISC_FEATURE (23)..(23): X is A and G
  MISC_FEATURE (24)..(24): X is A and G
  MISC_FEATURE (25)..(25): X is I, L or V
  MISC_FEATURE (26)..(26): X is I, L or V
  MISC_FEATURE (27)..(27): X is C or S
  MISC_FEATURE (28)..(28): X is T or S
  MISC_FEATURE (29)..(29): X is A or G
  MISC_FEATURE (30)..(30): X is I, L or V
  MISC_FEATURE (31)..(31): X is I, L or V

SEQ ID NO: 262 - protein, 39 aa, Artificial; identical to SEQ ID NO: 176
  peptide construct
  MISC_FEATURE (1)..(1): X is M or Nle
  MISC_FEATURE (2)..(2): X is D and E for acidic amino acids
  MISC_FEATURE (3)..(3): X is F, W or Y for aromatic amino acids
  MISC_FEATURE (4)..(4): X is F, W or Y for aromatic amino acids
  MISC_FEATURE (5)..(5): X is C or S
  MISC_FEATURE (6)..(6): X is I, L or V
  MISC_FEATURE (7)..(7): X is D and E for acidic amino acids
  MISC_FEATURE (8)..(8): X is K, R or H for basic amino acids
  MISC_FEATURE (9)..(9): X is D and E for acidic amino acids
  MISC_FEATURE (10)..(10): X is K, R or H for basic amino acids
  MISC_FEATURE (11)..(11): X is F or P
  MISC_FEATURE (12)..(12): X is F or P
  MISC_FEATURE (13)..(13): X is F or P
  MISC_FEATURE (14)..(14): X is A or G
  MISC_FEATURE (15)..(15): X is T or S
  MISC_FEATURE (16)..(16): X is F or P
  MISC_FEATURE (17)..(17): X is T or S
  MISC_FEATURE (18)..(18): X is C or S
  MISC_FEATURE (19)..(19): X is I, L or V
  MISC_FEATURE (20)..(20): X is T or S
  MISC_FEATURE (21)..(21): X is T or S
  MISC_FEATURE (22)..(22): X is A and G
  MISC_FEATURE (23)..(23): X is A or G
  MISC_FEATURE (24)..(24): X is A and G
  MISC_FEATURE (25)..(25): X is D and E for acidic amino acids
  MISC_FEATURE (26)..(26): X is A and G
  MISC_FEATURE (27)..(27): X is N or Q for amidated amino acids
  MISC_FEATURE (28)..(28): X is D and E for acidic amino acids
  MISC_FEATURE (29)..(29): X is D and E for acidic amino acids
  MISC_FEATURE (30)..(30): X is K, R or H for basic amino acids
  MISC_FEATURE (31)..(31): X is A and G
  MISC_FEATURE (32)..(32): X is A and G
  MISC_FEATURE (33)..(33): X is I, l or V
  MISC_FEATURE (34)..(34): X is I, L or V
  MISC_FEATURE (35)..(35): X is C or S
  MISC_FEATURE (36)..(36): X is T or S
  MISC_FEATURE (37)..(37): X is A and G
  MISC_FEATURE (38)..(38): X is I, L or V
  MISC_FEATURE (39)..(39): X is I, L or V

SEQ ID NO: 263 - protein, 28 aa, Artificial
  Completely synthesized peptide construct
ERPTLAFLQDGGGDGQEEKAGVVSTGLI

SEQ ID NO: 264 - protein, 28 aa, Artificial
  peptide construct
  MISC_FEATURE (1)..(1): X is D and E for acidic amino acids
  MISC_FEATURE (2)..(2): X is K, R or H for basic amino acids
  MISC_FEATURE (3)..(3): X is F or P
  MISC_FEATURE (4)..(4): X is T or S
  MISC_FEATURE (5)..(5): X is I, L or V
  MISC_FEATURE (6)..(6): X is A or G
  MISC_FEATURE (7)..(7): X is F, W or Y for aromatic amino acids
  MISC_FEATURE (8)..(8): X is I, L or V
  MISC_FEATURE (9)..(9): X is N or Q for amidated amino acids
  MISC_FEATURE (10)..(10): X is D and E for acidic amino acids
  MISC_FEATURE (11)..(11): X is A and G
  MISC_FEATURE (12)..(12): X is A or G
  MISC_FEATURE (13)..(13): X is A and G
  MISC_FEATURE (14)..(14): X is D and E for acidic amino acids
  MISC_FEATURE (15)..(15): X is A and G
  MISC_FEATURE (16)..(16): X is N or Q for amidated amino acids
  MISC_FEATURE (17)..(17): X is D and E for acidic amino acids
  MISC_FEATURE (18)..(18): X is D and E for acidic amino acids
  MISC_FEATURE (19)..(19): X is K, R or H for basic amino acids
  MISC_FEATURE (20)..(20): X is A and G
  MISC_FEATURE (21)..(21): X is A and G
  MISC_FEATURE (22)..(22): X is I, L or V
  MISC_FEATURE (23)..(23): X is I, L or V
  MISC_FEATURE (24)..(24): X is C or S
  MISC_FEATURE (25)..(25): X is T or S
  MISC_FEATURE (26)..(26): X is A or G
  MISC_FEATURE (27)..(27): X is I, L or V
  MISC_FEATURE (28)..(28): X is I, L or V
XXXXXXXXXXXXXXXXXXXXXXXXXXXX

SEQ ID NO: 265 - protein, 28 aa, Artificial
  Completely synthesized peptide construct
DRSTKVIDFHGGGDGQEEKAGVVSTGLI

SEQ ID NO: 266 - protein, 28 aa, Artificial
  peptide construct
  MISC_FEATURE (1)..(1): X is D and E for acidic amino acids
  MISC_FEATURE (2)..(2): X is K, R or H for basic amino acids
  MISC_FEATURE (3)..(3): X is C or S
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is I, L or V
  MISC_FEATURE (8)..(8): X is D and E for acidic amino acids
  MISC_FEATURE (9)..(9): X is F, W  or Y for aromatic amino acids
  MISC_FEATURE (10)..(10): X is K, R or H for basic amino acids
  MISC_FEATURE (11)..(11): X is A and G
  MISC_FEATURE (12)..(12): X is  A or G
  MISC_FEATURE (13)..(13): X is A and G
  MISC_FEATURE (14)..(14): X is D and E for acidic amino acids
  MISC_FEATURE (15)..(15): X is A and G
  MISC_FEATURE (16)..(16): X is N or Q for amidated amino acids
  MISC_FEATURE (17)..(17): X is D and E for acidic amino acids
  MISC_FEATURE (18)..(18): X is D and E for acidic amino acids
  MISC_FEATURE (19)..(19): X is K, R or H for basic amino acids
  MISC_FEATURE (20)..(20): X is A and G
  MISC_FEATURE (21)..(21): X is A and G
  MISC_FEATURE (22)..(22): X is I, L or V
  MISC_FEATURE (23)..(23): X is I, L or V
  MISC_FEATURE (24)..(24): X is C or S
  MISC_FEATURE (25)..(25): X is T or S
  MISC_FEATURE (26)..(26): X is A or G
  MISC_FEATURE (27)..(27): X is I, L or V
  MISC_FEATURE (28)..(28): X is I, L or V
XXXXXXXXXXXXXXXXXXXXXXXXXXXX

SEQ ID NO: 267 - protein, 31 aa, Artificial
  Completely synthesized peptide construct
IAGFKGEQGPKGEGGGDGQEEKAGVVSTGLI

SEQ ID NO: 268 - protein, 31 aa, Artificial; identical to SEQ ID NO: 123
  peptide construct
  MISC_FEATURE (1)..(1): X is I, L or V
  MISC_FEATURE (2)..(2): X is A or G
  MISC_FEATURE (3)..(3): X is A or G
  MISC_FEATURE (4)..(4): X is F, W or Y for aromatic amino acids
  MISC_FEATURE (5)..(5): X is K, R or H for basic amino acids
  MISC_FEATURE (6)..(6): X is A or G
  MISC_FEATURE (7)..(7): X is D and E for acidic amino acids
  MISC_FEATURE (8)..(8): X is N or Q for amidated amino acids
  MISC_FEATURE (9)..(9): X is A or G
  MISC_FEATURE (10)..(10): X is F or P
  MISC_FEATURE (11)..(11): X is K, R or H for basic amino acids
  MISC_FEATURE (12)..(12): X is A or G
  MISC_FEATURE (13)..(13): X is D and E for acidic amino acids
  MISC_FEATURE (14)..(14): X is A and G
  MISC_FEATURE (15)..(15): X is A for G
  MISC_FEATURE (16)..(16): X is A and G
  MISC_FEATURE (17)..(17): X is D and E for acidic amino acids
  MISC_FEATURE (18)..(18): X is A and G
  MISC_FEATURE (19)..(19): X is N or Q for amidated amino acids
  MISC_FEATURE (20)..(20): X is D and E for acidic amino acids
  MISC_FEATURE (21)..(21): X is D and E for acidic amino acids
  MISC_FEATURE (22)..(22): X is K, R or H for basic amino acids
  MISC_FEATURE (23)..(23): X is A and G
  MISC_FEATURE (24)..(24): X is A and G
  MISC_FEATURE (25)..(25): X is I, L or V
  MISC_FEATURE (26)..(26): X is I, L or V
  MISC_FEATURE (27)..(27): X is C or S
  MISC_FEATURE (28)..(28): X is T or S
  MISC_FEATURE (29)..(29): X is A and G
  MISC_FEATURE (30)..(30): X is I, L or V
  MISC_FEATURE (31)..(31): X is I, L or V

SEQ ID NO: 269 - protein, 18 aa, Artificial
  Completely synthesized peptide construct
GGGDGQEEKAGVVSTGLI

SEQ ID NO: 270 - protein, 35 aa, Artificial; identical to SEQ ID NO: 197
  peptide construct
  MISC_FEATURE (1)..(1): X is T or S
  MISC_FEATURE (2)..(2): X is I, L or V
  MISC_FEATURE (3)..(3): X is K, R or H for basic amino acids
  MISC_FEATURE (4)..(4): X is I, L or V
  MISC_FEATURE (5)..(5): X is T or S
  MISC_FEATURE (6)..(6): X is I, L or V
  MISC_FEATURE (7)..(7): X is A and G
  MISC_FEATURE (8)..(8): X is I, L or V
  MISC_FEATURE (9)..(9): X is K, R or H for basic amino acids
  MISC_FEATURE (10)..(10): X is N or Q for amidated amino acids
  MISC_FEATURE (11)..(11): X is K, R or H for basic amino acids
  MISC_FEATURE (12)..(12): X is A and G
  MISC_FEATURE (13)..(13): X is D and E for acidic amino acids
  MISC_FEATURE (14)..(14): X is F or P
  MISC_FEATURE (15)..(15): X is K, R or H for basic amino acids
  MISC_FEATURE (16)..(16): X is N or Q for amidated amino acids
  MISC_FEATURE (17)..(17): X is T or S
  MISC_FEATURE (18)..(18): X is A and G
  MISC_FEATURE (19)..(19): X is A and G
  MISC_FEATURE (20)..(20): X is A and G
  MISC_FEATURE (21)..(21): X is D and E for acidic amino acids
  MISC_FEATURE (22)..(22): X is A and G
  MISC_FEATURE (23)..(23): X is N or Q for amidated amino acids
  MISC_FEATURE (24)..(24): X is D and E for acidic amino acids
  MISC_FEATURE (25)..(25): X is D and E for acidic amino acids
  MISC_FEATURE (26)..(26): X is K, R or H for basic amino acids
  MISC_FEATURE (27)..(27): X is A and G
  MISC_FEATURE (28)..(28): X is A and G
  MISC_FEATURE (29)..(29): X is I, L or V
  MISC_FEATURE (30)..(30): X is I, L or V
  MISC_FEATURE (31)..(31): X is C or S
  MISC_FEATURE (32)..(32): X is T or S
  MISC_FEATURE (33)..(33): X is A and G
  MISC_FEATURE (34)..(34): X is I, L or V
  MISC_FEATURE (35)..(35): X is I, L or V

SEQ ID NO: 271 - protein, 26 aa, Artificial
  Completely synthesized peptide construct
KNIVTPRTGGGDGQEEKAGVVSTGLI

SEQ ID NO: 272 - protein, 26 aa, Artificial
  peptide construct
  MISC_FEATURE (1)..(1): X is K, R or H for basic amino acids
  MISC_FEATURE (2)..(2): X is N or Q for amidated amino acids
  MISC_FEATURE (3)..(3): X is I, L or V
  MISC_FEATURE (4)..(4): X is I, L or V
  MISC_FEATURE (5)..(5): X is T or S
  MISC_FEATURE (6)..(6): X is F or  P
  MISC_FEATURE (7)..(7): X is K, R or H for basic amino acids
  MISC_FEATURE (8)..(8): X is T or S
  MISC_FEATURE (9)..(9): X is A and G
  MISC_FEATURE (10)..(10): X is A or G
  MISC_FEATURE (11)..(11): X is A and G
  MISC_FEATURE (12)..(12): X is D and E for acidic amino acids
  MISC_FEATURE (13)..(13): X is A and G
  MISC_FEATURE (14)..(14): X is N or Q for amidated amino acids
  MISC_FEATURE (15)..(15): X is D and E for acidic amino acids
  MISC_FEATURE (16)..(16): X is D and E for acidic amino acids
  MISC_FEATURE (17)..(17): X is K, R or H for basic amino acids
  MISC_FEATURE (18)..(18): X is A and G
  MISC_FEATURE (19)..(19): X is A and G
  MISC_FEATURE (20)..(20): X is I, L or V
  MISC_FEATURE (21)..(21): X is I, L or V
  MISC_FEATURE (22)..(22): X is C or S
  MISC_FEATURE (23)..(23): X is T or S
  MISC_FEATURE (24)..(24): X is A and G
  MISC_FEATURE (25)..(25): X is I, L or V
  MISC_FEATURE (26)..(26): X is I, L or V
XXXXXXXXXXXXXXXXXXXXXXXXXX

SEQ ID NO: 273 - protein, 33 aa, Artificial
  Completely synthesized peptide construct
GDKVSFFCKNKEKKCGGGDGQEEKAGVVSTGLI

SEQ ID NO: 274 - protein, 33 aa, Artificial; identical to SEQ ID NO: 97
  peptide construct
  MISC_FEATURE (1)..(1): X is A or G
  MISC_FEATURE (2)..(2): X is D and E for acidic amino acids
  MISC_FEATURE (3)..(3): X is K, R or H for basic amino acids
  MISC_FEATURE (4)..(4): X is I, L or V
  MISC_FEATURE (5)..(5): X is C or S
  MISC_FEATURE (6)..(6): X is F, W or Y for aromatic amino acids
  MISC_FEATURE (7)..(7): X is F, W or Y for aromatic amino acids
  MISC_FEATURE (8)..(8): X is C or S
  MISC_FEATURE (9)..(9): X is K, R or H for basic amino acids
  MISC_FEATURE (10)..(10): X is N or Q for amidated amino acids
  MISC_FEATURE (11)..(11): X is K, R or H for basic amino acids
  MISC_FEATURE (12)..(12): X is D and E for acidic amino acids
  MISC_FEATURE (13)..(13): X is K, R or H for basic amino acids
  MISC_FEATURE (14)..(14): X is K, R or H for basic amino acids
  MISC_FEATURE (15)..(15): X is C or S
  MISC_FEATURE (16)..(16): X is A and G
  MISC_FEATURE (17)..(17): X is A or G
  MISC_FEATURE (18)..(18): X is A and G
  MISC_FEATURE (19)..(19): X is D and E for acidic amino acids
  MISC_FEATURE (20)..(20): X is A and G
  MISC_FEATURE (21)..(21): X is N or Q for amidated amino acids
  MISC_FEATURE (22)..(22): X is D and E for acidic amino acids
  MISC_FEATURE (23)..(23): X is D and E for acidic amino acids
  MISC_FEATURE (24)..(24): X is K, R or H for basic amino acids
  MISC_FEATURE (25)..(25): X is A and G
  MISC_FEATURE (26)..(26): X is A and G
  MISC_FEATURE (27)..(27): X is I, L or V
  MISC_FEATURE (28)..(28): X is I, L or V
  MISC_FEATURE (29)..(29): X is C or S
  MISC_FEATURE (30)..(30): X is T or S
  MISC_FEATURE (31)..(31): X is A and G
  MISC_FEATURE (32)..(32): X is I, L or V
  MISC_FEATURE (33)..(33): X is I, L or V

SEQ ID NO: 275 - protein, 35 aa, Artificial
  Completely synthesized peptide construct
EIIVTHFPFDEQNCSMKGGGDGQEEKAGVVSTGLI

SEQ ID NO: 276 - protein, 35 aa, Artificial; identical to SEQ ID NO: 197
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is I, L or V
  MISC_FEATURE (5)..(5): X is T or S
  MISC_FEATURE (6)..(6): X is K, R or H for basic amino acids
  MISC_FEATURE (7)..(7): X is F, W or Y for aromatic amino acids
  MISC_FEATURE (8)..(8): X is F or P
  MISC_FEATURE (9)..(9): X is F, W or Y for aromatic amino acids
  MISC_FEATURE (10)..(10): X is D and E for acidic amino acids
  MISC_FEATURE (11)..(11): X is D and E for acidic amino acids
  MISC_FEATURE (12)..(12): X is N or Q for amidated amino acids
  MISC_FEATURE (13)..(13): X is N or Q for amidated amino acids
  MISC_FEATURE (14)..(14): X is C or S
  MISC_FEATURE (15)..(15): X is C or S
  MISC_FEATURE (16)..(16): X is M or Nle
  MISC_FEATURE (17)..(17): X is K, R or H for basic amino acids
  MISC_FEATURE (18)..(18): X is A and G
  MISC_FEATURE (19)..(19): X is A or G
  MISC_FEATURE (20)..(20): X is A and G
  MISC_FEATURE (21)..(21): X is D and E for acidic amino acids
  MISC_FEATURE (22)..(22): X is A and G
  MISC_FEATURE (23)..(23): X is N or Q for amidated amino acids
  MISC_FEATURE (24)..(24): X is  D and E for acidic amino acids
  MISC_FEATURE (25)..(25): X is D and E for acidic amino acids
  MISC_FEATURE (26)..(26): X is K, R or H for basic amino acids
  MISC_FEATURE (27)..(27): X is A and G
  MISC_FEATURE (28)..(28): X is A and G
  MISC_FEATURE (29)..(29): X is I, L or V
  MISC_FEATURE (30)..(30): X is I, L or V
  MISC_FEATURE (31)..(31): X is C or S
  MISC_FEATURE (32)..(32): X is T or S
  MISC_FEATURE (33)..(33): X is A or G
  MISC_FEATURE (34)..(34): X is I, L or V
  MISC_FEATURE (35)..(35): X is I, L or V

SEQ ID NO: 277 - protein, 31 aa, Artificial
  Completely synthesized peptide construct
VHFFKNIVTPRTPGGGDGQEEKAGVVSTGLI

SEQ ID NO: 278 - protein, 31 aa, Artificial; identical to SEQ ID NO: 123
  peptide construct
  MISC_FEATURE (1)..(1): X is I, L or V
  MISC_FEATURE (2)..(2): X is K, R or H for basic amino acids
  MISC_FEATURE (3)..(3): X is F, W or Y for aromatic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is N or Q for amidated amino acids
  MISC_FEATURE (7)..(7): X is I, L or V
  MISC_FEATURE (8)..(8): X is I, L or V
  MISC_FEATURE (9)..(9): X is T or S
  MISC_FEATURE (10)..(10): X is F or P
  MISC_FEATURE (11)..(11): X is K, R or H for basic amino acids
  MISC_FEATURE (12)..(12): X is T or S
  MISC_FEATURE (13)..(13): X is F or P
  MISC_FEATURE (14)..(14): X is A and G
  MISC_FEATURE (15)..(15): X is A or G
  MISC_FEATURE (16)..(16): X is A and G
  MISC_FEATURE (17)..(17): X is D and E for acidic amino acids
  MISC_FEATURE (18)..(18): X is A and G
  MISC_FEATURE (19)..(19): X is N or Q for amidated amino acids
  MISC_FEATURE (20)..(20): X is D and E for acidic amino acids
  MISC_FEATURE (21)..(21): X is D and E for acidic amino acids
  MISC_FEATURE (22)..(22): X is K, R or H for basic amino acids
  MISC_FEATURE (23)..(23): X is A and G
  MISC_FEATURE (24)..(24): X is A and G
  MISC_FEATURE (25)..(25): X is I, L or V
  MISC_FEATURE (26)..(26): X is I, L or V
  MISC_FEATURE (27)..(27): X is C or S
  MISC_FEATURE (28)..(28): X is T or S
  MISC_FEATURE (29)..(29): X is A and G
  MISC_FEATURE (30)..(30): X is I, L or V
  MISC_FEATURE (31)..(31): X is I, L or V

SEQ ID NO: 279 - protein, 36 aa, Artificial
  Completely synthesized peptide construct
YQQLNSERVGVPNENIENGGGDGQEEKAGVVSTGLI

SEQ ID NO: 280 - protein, 35 aa, Artificial; identical to SEQ ID NO: 197
  peptide construct
  MISC_FEATURE (1)..(1): X is F, W or Y for aromatic amino acids
  MISC_FEATURE (2)..(2): X is N or Q for amidated amino acids
  MISC_FEATURE (3)..(3): X is N or Q for amidated amino acids
  MISC_FEATURE (4)..(4): X is I, L or V
  MISC_FEATURE (5)..(5): X is N or Q for amidated amino acids
  MISC_FEATURE (6)..(6): X is C or S
  MISC_FEATURE (7)..(7): X is D and E for acidic amino acids
  MISC_FEATURE (8)..(8): X is K, R or H for basic amino acids
  MISC_FEATURE (9)..(9): X is A or G
  MISC_FEATURE (10)..(10): X is I, L or V
  MISC_FEATURE (11)..(11): X is F or P
  MISC_FEATURE (12)..(12): X is N or Q for amidated amino acids
  MISC_FEATURE (13)..(13): X is D and E for acidic amino acids
  MISC_FEATURE (14)..(14): X is N or Q for amidated amino acids
  MISC_FEATURE (15)..(15): X is I, L or V
  MISC_FEATURE (16)..(16): X is D and E for acidic amino acids
  MISC_FEATURE (17)..(17): X is N or Q for amidated amino acids
  MISC_FEATURE (18)..(18): X is A and G
  MISC_FEATURE (19)..(19): X is A or G
  MISC_FEATURE (20)..(20): X is  A and G
  MISC_FEATURE (21)..(21): X is D and E for acidic amino acids
  MISC_FEATURE (22)..(22): X is A and G
  MISC_FEATURE (23)..(23): X is N or Q for amidated amino acids
  MISC_FEATURE (24)..(24): X is D and E for acidic amino acids
  MISC_FEATURE (25)..(25): X is D and E for acidic amino acids
  MISC_FEATURE (26)..(26): X is K, R or H for basic amino acids
  MISC_FEATURE (27)..(27): X is A and G
  MISC_FEATURE (28)..(28): X is A and G
  MISC_FEATURE (29)..(29): X is I, L or V
  MISC_FEATURE (30)..(30): X is I, L or V
  MISC_FEATURE (31)..(31): X is C or S
  MISC_FEATURE (32)..(32): X is T or S
  MISC_FEATURE (33)..(33): X is A or G
  MISC_FEATURE (34)..(34): X is I, L or V
  MISC_FEATURE (35)..(35): X is I, L or V

SEQ ID NO: 281 - protein, 31 aa, Artificial
  Completely synthesized peptide construct
VFIKRVSNVIIHGGGGDGQEEKAGVVSTGLI

SEQ ID NO: 282 - protein, 31 aa, Artificial; identical to SEQ ID NO: 123
  peptide construct
  MISC_FEATURE (1)..(1): X is I, L or V
  MISC_FEATURE (2)..(2): X is F, W or Y for aromatic amino acids
  MISC_FEATURE (3)..(3): X is I, L or V
  MISC_FEATURE (4)..(4): X is K,  R or H for basic amino acids
  MISC_FEATURE (5)..(5): X is K, R or H for basic amino acids
  MISC_FEATURE (6)..(6): X is I, L or V
  MISC_FEATURE (7)..(7): X is C or S
  MISC_FEATURE (8)..(8): X is N or Q for amidated amino acids
  MISC_FEATURE (9)..(9): X is I, L or V
  MISC_FEATURE (10)..(10): X is I, L or V
  MISC_FEATURE (11)..(11): X is I, L or V
  MISC_FEATURE (12)..(12): X is K, R or H for basic amino acids
  MISC_FEATURE (13)..(13): X is A or G
  MISC_FEATURE (14)..(14): X is A and G
  MISC_FEATURE (15)..(15): X is A or G
  MISC_FEATURE (16)..(16): X is A and G
  MISC_FEATURE (17)..(17): X is D and E for acidic amino acids
  MISC_FEATURE (18)..(18): X is A and G
  MISC_FEATURE (19)..(19): X is N or Q for amidated amino acids
  MISC_FEATURE (20)..(20): X is D and E for acidic amino acids
  MISC_FEATURE (21)..(21): X is D and E for acidic amino acids
  MISC_FEATURE (22)..(22): X is K, R or H for basic amino acids
  MISC_FEATURE (23)..(23): X is A and G
  MISC_FEATURE (24)..(24): X is A and G
  MISC_FEATURE (25)..(25): X is I, L or V
  MISC_FEATURE (26)..(26): X is I, L or V
  MISC_FEATURE (27)..(27): X is C or S
  MISC_FEATURE (28)..(28): X is T or S
  MISC_FEATURE (29)..(29): X is A or G
  MISC_FEATURE (30)..(30): X is I, L or V
  MISC_FEATURE (31)..(31): X is I, L or V

SEQ ID NO: 283 - protein, 33 aa, Artificial
  Completely synthesized peptide construct
MKVTVAFNQFGPNRRGGGDGQEEKAGVVSTGLI

SEQ ID NO: 284 - protein, 33 aa, Artificial; identical to SEQ ID NO: 97
  peptide construct
  MISC_FEATURE (1)..(1): X is M or Nle
  MISC_FEATURE (2)..(2): X is K, R or H for basic amino acids
  MISC_FEATURE (3)..(3): X is I, L or V
  MISC_FEATURE (4)..(4): X is Tor S
  MISC_FEATURE (5)..(5): X is I, L or V
  MISC_FEATURE (6)..(6): X is A or G
  MISC_FEATURE (7)..(7): X is F, W or Y for amidated amino acids
  MISC_FEATURE (8)..(8): X is N or Q for amidated amion acids
  MISC_FEATURE (9)..(9): X is N or Q for amidated amino acids
  MISC_FEATURE (10)..(10): X is F, W or Y for aromatic amino acids
  MISC_FEATURE (11)..(11): X is A or G
  MISC_FEATURE (12)..(12): X is F or P
  MISC_FEATURE (13)..(13): X is N or Q for amidated amino acids
  MISC_FEATURE (14)..(14): X is K, R or H for basic amino acids
  MISC_FEATURE (15)..(15): X is K, R or H for basic amino acids
  MISC_FEATURE (16)..(16): X is A and G
  MISC_FEATURE (17)..(17): X is A or G
  MISC_FEATURE (18)..(18): X is A and G
  MISC_FEATURE (19)..(19): X is D and E for acidic amino acids
  MISC_FEATURE (20)..(20): X is A and G
  MISC_FEATURE (21)..(21): X is N or Q for amidated amino acids
  MISC_FEATURE (22)..(22): X is D and E for acidic amino acids
  MISC_FEATURE (23)..(23): X is D and E for acidic amino acids
  MISC_FEATURE (24)..(24): X is K, R or H for basic amino acids
  MISC_FEATURE (25)..(25): X is A and G
  MISC_FEATURE (26)..(26): X is A and G
  MISC_FEATURE (27)..(27): X is  I, L or V
  MISC_FEATURE (28)..(28): X is I, L or V
  MISC_FEATURE (29)..(29): X is C or S
  MISC_FEATURE (30)..(30): X is T or S
  MISC_FEATURE (31)..(31): X is A or G
  MISC_FEATURE (32)..(32): X is I, L or V
  MISC_FEATURE (33)..(33): X is I, L or V

SEQ ID NO: 285 - protein, 33 aa, Artificial
  Completely synthesized peptide construct
IASRRVDGIIAAYQNGGGDGQEEKAGVVSTGLI

SEQ ID NO: 286 - protein, 33 aa, Artificial; identical to SEQ ID NO: 97
  peptide construct
  MISC_FEATURE (1)..(1): X is I, L or V
  MISC_FEATURE (2)..(2): X is A or G
  MISC_FEATURE (3)..(3): X is C or S
  MISC_FEATURE (4)..(4): X is K, R or H for basic amino acids
  MISC_FEATURE (5)..(5): X is K, R or H for basic amino acids
  MISC_FEATURE (6)..(6): X is I, L or V
  MISC_FEATURE (7)..(7): X is D and E for acidic amino acids
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is A or G
  MISC_FEATURE (12)..(12): X is A or G
  MISC_FEATURE (13)..(13): X is F, W or Y for aromatic amino acids
  MISC_FEATURE (14)..(14): X is N or Q for amidated amino acids
  MISC_FEATURE (15)..(15): X is N or Q for amidated amino acids
  MISC_FEATURE (16)..(16): X is A and G
  MISC_FEATURE (17)..(17): X is A or G
  MISC_FEATURE (18)..(18): X is A and G
  MISC_FEATURE (19)..(19): X is D and E for acidic amino acids
  MISC_FEATURE (20)..(20): X is A and G
  MISC_FEATURE (21)..(21): X is N or Q for amidated amino acids
  MISC_FEATURE (22)..(22): X is D and E for acidic amino acids
  MISC_FEATURE (23)..(23): X is D and E for acidic amino acids
  MISC_FEATURE (24)..(24): X is K, R or H for basic amino acids
  MISC_FEATURE (25)..(25): X is A and G
  MISC_FEATURE (26)..(26): X is A and G
  MISC_FEATURE (27)..(27): X is I, L or V
  MISC_FEATURE (28)..(28): X is I, L or V
  MISC_FEATURE (29)..(29): X is C or S
  MISC_FEATURE (30)..(30): X is T or S
  MISC_FEATURE (31)..(31): X is A or G
  MISC_FEATURE (32)..(32): X is I, L or V
  MISC_FEATURE (33)..(33): X is I, L or V

SEQ ID NO: 287 - protein, 37 aa, Artificial
  Completely synthesized peptide construct
IDIFASKNFHLQKNTIGTGGGGDGQEEKAGVVSTGLI

SEQ ID NO: 288 - protein, 37 aa, Artificial; identical to SEQ ID NO: 151
  peptide construct
  MISC_FEATURE (1)..(1): X is I, L or V
  MISC_FEATURE (2)..(2): X is D and E for acidic amino acids
  MISC_FEATURE (3)..(3): X is I, L or V
  MISC_FEATURE (4)..(4): X is F, W or  Y for aromatic amino acids
  MISC_FEATURE (5)..(5): X is A or G
  MISC_FEATURE (6)..(6): X is C or S
  MISC_FEATURE (7)..(7): X is K, R or H for basic amino acids
  MISC_FEATURE (8)..(8): X is N or Q for amidated amino acids
  MISC_FEATURE (9)..(9): X is F, W or Y for aromatic amino acids
  MISC_FEATURE (10)..(10): X is K, R or H for basic amino acids
  MISC_FEATURE (11)..(11): X is I, L or V
  MISC_FEATURE (12)..(12): X is N or Q for amidated amino acids
  MISC_FEATURE (13)..(13): X is K, R or H for basic amino acids
  MISC_FEATURE (14)..(14): X is N or Q for amidated amino acids
  MISC_FEATURE (15)..(15): X is T or S
  MISC_FEATURE (16)..(16): X is I, L or V
  MISC_FEATURE (17)..(17): X is A or G
  MISC_FEATURE (18)..(18): X is T or S
  MISC_FEATURE (19)..(19): X is A or G
  MISC_FEATURE (20)..(20): X is A and G
  MISC_FEATURE (21)..(21): X is A or G
  MISC_FEATURE (22)..(22): X is A and G
  MISC_FEATURE (23)..(23): X is D and E for acidic amino acids
  MISC_FEATURE (24)..(24): X is A and G
  MISC_FEATURE (25)..(25): X is N or Q for amidated amino acids
  MISC_FEATURE (26)..(26): X is D and E for acidic amino acids
  MISC_FEATURE (27)..(27): X is D and E for acidic amino acids
  MISC_FEATURE (28)..(28): X is K, R or H for basic amino acids
  MISC_FEATURE (29)..(29): X is A and G
  MISC_FEATURE (30)..(30): X is A and G
  MISC_FEATURE (31)..(31): X is I, L or V
  MISC_FEATURE (32)..(32): X is I, L or V
  MISC_FEATURE (33)..(33): X is C or S
  MISC_FEATURE (34)..(34): X is T or S
  MISC_FEATURE (35)..(35): X is A or G
  MISC_FEATURE (36)..(36): X is I, L or V
  MISC_FEATURE (37)..(37): X is I, L or V

SEQ ID NO: 289 - protein, 43 aa, Artificial
  Completely synthesized peptide construct
GIGAVLKVLTTGPALISWIKRKRQQGGGDGQEEKAGVVSTGLI

SEQ ID NO: 290 - protein, 43 aa, Artificial; identical to SEQ ID NO: 211
  peptide construct
  MISC_FEATURE (1)..(1): X is D and E for acidic amino acids
  MISC_FEATURE (2)..(2): X is I, L or V
  MISC_FEATURE (3)..(3): X is A or G
  MISC_FEATURE (4)..(4): X is A or G
  MISC_FEATURE (5)..(5): X is I, L or V
  MISC_FEATURE (6)..(6): X is I, L or V
  MISC_FEATURE (7)..(7): X is K, R or H for basic amino acids
  MISC_FEATURE (8)..(8): X is I, L or V
  MISC_FEATURE (9)..(9): X is I, L or V
  MISC_FEATURE (10)..(10): X is T or S
  MISC_FEATURE (11)..(11): X is T or S
  MISC_FEATURE (12)..(12): X is A or G
  MISC_FEATURE (13)..(13): X is F or P
  MISC_FEATURE (14)..(14): X is A or G
  MISC_FEATURE (15)..(15): X is I, L or V
  MISC_FEATURE (16)..(16): X is I, L or V
  MISC_FEATURE (17)..(17): X is C or S
  MISC_FEATURE (18)..(18): X is F, W or  Y for aromatic amino acids
  MISC_FEATURE (19)..(19): X is I, L or V
  MISC_FEATURE (20)..(20): X is K, R or H for basic amino acids
  MISC_FEATURE (21)..(21): X is K, R or H for basic amino acids
  MISC_FEATURE (22)..(22): X is K, R or H for basic amino acids
  MISC_FEATURE (23)..(23): X is K, R or H for basic amino acids
  MISC_FEATURE (24)..(24): X is N or Q for amidated amino acids
  MISC_FEATURE (25)..(25): X is N or Q for amidated amino acids
  MISC_FEATURE (26)..(26): X is A and G
  MISC_FEATURE (27)..(27): X is A or G
  MISC_FEATURE (28)..(28): X is A and G
  MISC_FEATURE (29)..(29): X is D and E for acidici amino acids
  MISC_FEATURE (30)..(30): X is A and G
  MISC_FEATURE (31)..(31): X is N or Q for amidated amino acids
  MISC_FEATURE (32)..(32): X is D and E for acidic amino acids
  MISC_FEATURE (33)..(33): X is D and E for acidic amino acids
  MISC_FEATURE (34)..(34): X is K, R or H for basic amino acids
  MISC_FEATURE (35)..(35): X is A and G
  MISC_FEATURE (36)..(36): X is A and G
  MISC_FEATURE (37)..(37): X is  I, L or V
  MISC_FEATURE (38)..(38): X is I, L or V
  MISC_FEATURE (39)..(39): X is C or S
  MISC_FEATURE (40)..(40): X is T or S
  MISC_FEATURE (41)..(41): X is A or G
  MISC_FEATURE (42)..(42): X is I, L or V
  MISC_FEATURE (43)..(43): X is I, L or V

SEQ ID NO: 291 - protein, 56 aa, Artificial
  Completely synthesized peptide construct
DLLKNGERIEKVEGGGDAEFRHDSGYEVHHQKLVFFAEDVGSNKGAIIGLMVGGVV

SEQ ID NO: 292 - protein, 56 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is D and E for acidic amino acids
  MISC_FEATURE (18)..(18): X is A or G
  MISC_FEATURE (19)..(19): X is D and E for acidic amino acids
  MISC_FEATURE (20)..(20): X is F, W or Y for aromatic amino acids
  MISC_FEATURE (21)..(21): X is K, R or H for basic amino acids
  MISC_FEATURE (22)..(22): X is K, R or H for basic amino acids
  MISC_FEATURE (23)..(23): X is D and E for acidic amino acids
  MISC_FEATURE (24)..(24): X is T or S
  MISC_FEATURE (25)..(25): X is A or G
  MISC_FEATURE (26)..(26): X is F, W or Y for aromatic amino acids
  MISC_FEATURE (27)..(27): X is D and E for acidic amino acids
  MISC_FEATURE (28)..(28): X is I, L or V
  MISC_FEATURE (29)..(29): X is K, R or H for basic amino acids
  MISC_FEATURE (30)..(30): X is K, R or H for basic amino acids
  MISC_FEATURE (31)..(31): X is N or Q for amidated amino acids
  MISC_FEATURE (32)..(32): X is K, R or H for basic amino acids
  MISC_FEATURE (33)..(33): X is I, L or V
  MISC_FEATURE (34)..(34): X is I, L or V
  MISC_FEATURE (35)..(35): X is F, W or Y for aromatic amino acids
  MISC_FEATURE (36)..(36): X is F, W or Y for aromatic amino acids
  MISC_FEATURE (37)..(37): X is A or G
  MISC_FEATURE (38)..(38): X is D and E for acidic amino acids
  MISC_FEATURE (39)..(39): X is D and E for acidic amino acids
  MISC_FEATURE (40)..(40): X is I, L or V
  MISC_FEATURE (41)..(41): X is A or G
  MISC_FEATURE (42)..(42): X is C or S
  MISC_FEATURE (43)..(43): X is N or Q for amidated amino acids
  MISC_FEATURE (44)..(44): X is K, R or H for basic amino acids
  MISC_FEATURE (45)..(45): X is A or G
  MISC_FEATURE (46)..(46): X is A or G
  MISC_FEATURE (47)..(47): X is I, L or V
  MISC_FEATURE (48)..(48): X is I, L or V
  MISC_FEATURE (49)..(49): X is A or G
  MISC_FEATURE (50)..(50): X is I, L or V
  MISC_FEATURE (51)..(51): X is M or Nle
  MISC_FEATURE (52)..(52): X is I, L or V
  MISC_FEATURE (53)..(53): X is A or G
  MISC_FEATURE (54)..(54): X is A or G
  MISC_FEATURE (55)..(55): X is I, L or V
  MISC_FEATURE (56)..(56): X is I, L or V
XXXXXXXXXXXXXXXXXXXXXXXXXXXXXXXXXXXXXXXXXXXXXXXXXXXXXXXX

SEQ ID NO: 293 - protein, 44 aa, Artificial
  Completely synthesized peptide construct
DLLKNGERIEKVEGGGDAEFRHDSGYEVHHQKLVFFAENVGSNK

SEQ ID NO: 294 - protein, 44 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is D and E for acidic amino acids
  MISC_FEATURE (18)..(18): X is A or G
  MISC_FEATURE (19)..(19): X is D and E for acidic amino acids
  MISC_FEATURE (20)..(20): X is F, W or Y for aromatic amino acids
  MISC_FEATURE (21)..(21): X is K, R or H for basic amino acids
  MISC_FEATURE (22)..(22): X is K, R or H for basic amino acids
  MISC_FEATURE (23)..(23): X is D and E for acidic amino acids
  MISC_FEATURE (24)..(24): X is T or S
  MISC_FEATURE (25)..(25): X is A or G
  MISC_FEATURE (26)..(26): X is F, W or Y for aromatic amino acids
  MISC_FEATURE (27)..(27): X is D and E for acidic amino acids
  MISC_FEATURE (28)..(28): X is I, L or V
  MISC_FEATURE (29)..(29): X is K, R or H for basic amino acids
  MISC_FEATURE (30)..(30): X is K, R or H for basic amino acids
  MISC_FEATURE (31)..(31): X is N or Q for amidated amino acids
  MISC_FEATURE (32)..(32): X is K, R or H for basic amino acids
  MISC_FEATURE (33)..(33): X is I, L or V
  MISC_FEATURE (34)..(34): X is I, L or V
  MISC_FEATURE (35)..(35): X is F, W or Y for aromatic amino acids
  MISC_FEATURE (36)..(36): X is F, W or Y for aromatic amino acids
  MISC_FEATURE (37)..(37): X is A or G
  MISC_FEATURE (38)..(38): X is D and E for acidic amino acids
  MISC_FEATURE (39)..(39): X is D and E for acidic amino acids
  MISC_FEATURE (40)..(40): X is I, L or V
  MISC_FEATURE (41)..(41): X is A or G
  MISC_FEATURE (42)..(42): X is C or S
  MISC_FEATURE (43)..(43): X is N or Q for amidated amino acids
  MISC_FEATURE (44)..(44): X is K, R or H for basic amino acids
XXXXXXXXXXXXXXXXXXXXXXXXXXXXXXXXXXXXXXXXXXXX

SEQ ID NO: 295 - protein, 45 aa, Artificial
  Completely synthesized peptide construct
DLKNGERIEKVEGGGDAEFRHDSGYEVHHQKLVFFAENVGSNKAI

SEQ ID NO: 296 - protein, 46 aa, Artificial; identical to SEQ ID NO: 137
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is D and E for acidic amino acids
  MISC_FEATURE (18)..(18): X is A or G
  MISC_FEATURE (19)..(19): X is D and E for acidic amino acids
  MISC_FEATURE (20)..(20): X is F, W or Y for aromatic amino acids
  MISC_FEATURE (21)..(21): X is K, R or H for basic amino acids
  MISC_FEATURE (22)..(22): X is K, R or H for basic amino acids
  MISC_FEATURE (23)..(23): X is D and E for acidic amino acids
  MISC_FEATURE (24)..(24): X is T or S
  MISC_FEATURE (25)..(25): X is A or G
  MISC_FEATURE (26)..(26): X is F, W or Y for aromatic amino acids
  MISC_FEATURE (27)..(27): X is D and E for acidic amino acids
  MISC_FEATURE (28)..(28): X is I, L or V
  MISC_FEATURE (29)..(29): X is K, R or H for basic amino acids
  MISC_FEATURE (30)..(30): X is K, R or H for basic amino acids
  MISC_FEATURE (31)..(31): X is N or Q for amidated amino acids
  MISC_FEATURE (32)..(32): X is K, R or H for basic amino acids
  MISC_FEATURE (33)..(33): X is I, L or V
  MISC_FEATURE (34)..(34): X is I, L or V
  MISC_FEATURE (35)..(35): X is F, W or Y for aromatic amino acids
  MISC_FEATURE (36)..(36): X is F, W or Y for aromatic amino acids
  MISC_FEATURE (37)..(37): X is A or G
  MISC_FEATURE (38)..(38): X is D and E for acidic amino acids
  MISC_FEATURE (39)..(39): X is D and E for acidic amino acids
  MISC_FEATURE (40)..(40): X is I, L or V
  MISC_FEATURE (41)..(41): X is A or G
  MISC_FEATURE (42)..(42): X is C or S
  MISC_FEATURE (43)..(43): X is N or Q for amidated amino acids
  MISC_FEATURE (44)..(44): X is K, R or H for basic amino acids
  MISC_FEATURE (45)..(45): X is A or G
  MISC_FEATURE (46)..(46): X is I, L or V

SEQ ID NO: 297 - protein, 27 aa, Artificial
  Completely synthesized peptide construct
DLLKNGERIEKVEGGGDAEFRHDSGYE

SEQ ID NO: 298 - protein, 27 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is D and E for acidic amino acids
  MISC_FEATURE (18)..(18): X is A or G
  MISC_FEATURE (19)..(19): X is D and E for acidic amino acids
  MISC_FEATURE (20)..(20): X is F, W or Y for aromatic amino acids
  MISC_FEATURE (21)..(21): X is K, R or H for basic amino acids
  MISC_FEATURE (22)..(22): X is K, R or H for basic amino acids
  MISC_FEATURE (23)..(23): X is D and E for acidic amino acids
  MISC_FEATURE (24)..(24): X is T or S
  MISC_FEATURE (25)..(25): X is A or G
  MISC_FEATURE (26)..(26): X is F, W or Y for aromatic amino acids
  MISC_FEATURE (27)..(27): X is D and E for acidic amino acids
XXXXXXXXXXXXXXXXXXXXXXXXXXX

SEQ ID NO: 299 - protein, 23 aa, Artificial
  Completely synthesized peptide construct
DLLKNGERIEKVEGGGENVGSNK

SEQ ID NO: 300 - protein, 23 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is D and E for acidic amino acids
  MISC_FEATURE (18)..(18): X is D and E for acidic amino acids
  MISC_FEATURE (19)..(19): X is I, L or V
  MISC_FEATURE (20)..(20): X is A or G
  MISC_FEATURE (21)..(21): X is C or S
  MISC_FEATURE (22)..(22): X is N or Q for amidated amino acids
  MISC_FEATURE (23)..(23): X is K, R or H for basic amino acids
XXXXXXXXXXXXXXXXXXXXXXX

SEQ ID NO: 301 - protein, 28 aa, Artificial
  Completely synthesized peptide construct
DLLKNGERIEKVEGGGDAEFRHDSGYEV

SEQ ID NO: 302 - protein, 28 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is D and E for acidic amino acids
  MISC_FEATURE (18)..(18): X is A or G
  MISC_FEATURE (19)..(19): X is D and E for acidic amino acids
  MISC_FEATURE (20)..(20): X is F, W or Y for aromatic amino acids
  MISC_FEATURE (21)..(21): X is K, R or H for basic amino acids
  MISC_FEATURE (22)..(22): X is K, R or H for basic amino acids
  MISC_FEATURE (23)..(23): X is D and E for acidic amino acids
  MISC_FEATURE (24)..(24): X is T or S
  MISC_FEATURE (25)..(25): X is A or G
  MISC_FEATURE (26)..(26): X is F, W or Y for aromatic amino acids
  MISC_FEATURE (27)..(27): X is D and E for acidic amino acids
  MISC_FEATURE (28)..(28): X is I, L or V
XXXXXXXXXXXXXXXXXXXXXXXXXXXX

SEQ ID NO: 303 - protein, 26 aa, Artificial
  Completely synthesized peptide construct
DLLKNGERIEKVEGGGDAEFRHDSGY

SEQ ID NO: 304 - protein, 26 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is D and E for acidic amino acids
  MISC_FEATURE (18)..(18): X is A or G
  MISC_FEATURE (19)..(19): X is D and Efor acidic amino acids
  MISC_FEATURE (20)..(20): X is F, W or Y for aromatic amino acids
  MISC_FEATURE (21)..(21): X is K, R or H for basic amino acids
  MISC_FEATURE (22)..(22): X is K, R or H for basic amino acids
  MISC_FEATURE (23)..(23): X is D and E for acidic amino acids
  MISC_FEATURE (24)..(24): X is T or S
  MISC_FEATURE (25)..(25): X is A or G
  MISC_FEATURE (26)..(26): X is F, W or Y for aromatic amino acids
XXXXXXXXXXXXXXXXXXXXXXXXXX

SEQ ID NO: 305 - protein, 20 aa, Artificial
  Completely synthesized peptide construct
DLLKNGERIEKVEGGGEFRH

SEQ ID NO: 306 - protein, 20 aa, Artificial
  peptide construct
  MISC_FEATURE (1)..(1): X  is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for aromatic amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is D and E for acidic amino acids
  MISC_FEATURE (18)..(18): X is F or P
  MISC_FEATURE (19)..(19): X is K, R or H for basic amino acids
  MISC_FEATURE (20)..(20): X is K, R or H for basic amino acids
XXXXXXXXXXXXXXXXXXXX

SEQ ID NO: 307 - protein, 35 aa, Artificial
  Completely synthesized peptide construct
DLLKNGERIEKVEGGGDSAFDVLSFTAEEKAGVYK

SEQ ID NO: 308 - protein, 35 aa, Artificial; identical to SEQ ID NO: 197
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is D and E for acidic amino acids
  MISC_FEATURE (18)..(18): X is C or S
  MISC_FEATURE (19)..(19): X is A or G
  MISC_FEATURE (20)..(20): X is F, W or Y for aromatic amino acids
  MISC_FEATURE (21)..(21): X is D and E for acidic amino acids
  MISC_FEATURE (22)..(22): X is I, L or V
  MISC_FEATURE (23)..(23): X is I, L or V
  MISC_FEATURE (24)..(24): X is C or S
  MISC_FEATURE (25)..(25): X is F, W or Y for aromatic amino acids
  MISC_FEATURE (26)..(26): X is T or S
  MISC_FEATURE (27)..(27): X is A or G
  MISC_FEATURE (28)..(28): X is D and E for acidic amino acids
  MISC_FEATURE (29)..(29): X is D and E for acidic amino acids
  MISC_FEATURE (30)..(30): X is K, R or H for basic amino acids
  MISC_FEATURE (31)..(31): X is A or G
  MISC_FEATURE (32)..(32): X is A or G
  MISC_FEATURE (33)..(33): X is I, L or V
  MISC_FEATURE (34)..(34): X is F, W or  Y for aromatic amino acids
  MISC_FEATURE (35)..(35): X is K, R or H for basic amino acids

SEQ ID NO: 309 - protein, 30 aa, Artificial Sequence
  Completely synthesized peptide construct
DLLKNGERIEKVEGGGSLKLMATLFSTYAS

SEQ ID NO: 310 - protein, 30 aa, Artificial; identical to SEQ ID NO: 56
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is C or S
  MISC_FEATURE (18)..(18): X is I, L or V
  MISC_FEATURE (19)..(19): X is K, R or H for basic amino acids
  MISC_FEATURE (20)..(20): X is I, L or V
  MISC_FEATURE (21)..(21): X is M  or Nle
  MISC_FEATURE (22)..(22): X is A or G
  MISC_FEATURE (23)..(23): X is  T or S
  MISC_FEATURE (24)..(24): X is I, L or V
  MISC_FEATURE (25)..(25): X is F or P
  MISC_FEATURE (26)..(26): X is C or S
  MISC_FEATURE (27)..(27): X is T or S
  MISC_FEATURE (28)..(28): X is F, W or Y for aromatic amino acids
  MISC_FEATURE (29)..(29): X is A or G
  MISC_FEATURE (30)..(30): X is C or S

SEQ ID NO: 311 - protein, 30 aa, Artificial Sequence
  Completely synthesized peptide construct
DLLKNGERIEKVEGGGSLKLMATLFSSYAT

SEQ ID NO: 312 - protein, 30 aa, Artificial; identical to SEQ ID NO: 56
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is C or S
  MISC_FEATURE (18)..(18): X is I, L or V
  MISC_FEATURE (19)..(19): X is K, R or H for basic amino acids
  MISC_FEATURE (20)..(20): X is I, L or V
  MISC_FEATURE (21)..(21): X is M or Nle
  MISC_FEATURE (22)..(22): X is A or G
  MISC_FEATURE (23)..(23): X is Tor S
  MISC_FEATURE (24)..(24): X is I, L or V
  MISC_FEATURE (25)..(25): X is F or P
  MISC_FEATURE (26)..(26): X is C or S
  MISC_FEATURE (27)..(27): X is C or S
  MISC_FEATURE (28)..(28): X is F, W or Y for aromatic amino acids
  MISC_FEATURE (29)..(29): X is A or G
  MISC_FEATURE (30)..(30): X is T or S

SEQ ID NO: 313 - protein, 27 aa, Artificial
  Completely synthesized peptide construct
DLKKNGERIEKVEGGGNITEIADLTQK

SEQ ID NO: 314 - protein, 27 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K,  R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is N or Q for amidated amino acids
  MISC_FEATURE (18)..(18): X is I, L or V
  MISC_FEATURE (19)..(19): X is T or S
  MISC_FEATURE (20)..(20): X is D and E for acidic amino acids
  MISC_FEATURE (21)..(21): X is I, L or V
  MISC_FEATURE (22)..(22): X is A or G
  MISC_FEATURE (23)..(23): X is D and E for acidic amino acids
  MISC_FEATURE (24)..(24): X is I, L or V
  MISC_FEATURE (25)..(25): X is T or S
  MISC_FEATURE (26)..(26): X is N or Q for amidated amino acids
  MISC_FEATURE (27)..(27): X is K, R or H for basic amino acids
XXXXXXXXXXXXXXXXXXXXXXXXXXX

SEQ ID NO: 315 - protein, 56 aa, Artificial
  Completely synthesized peptide construct
DLLKNGERIEKVEGGGNMYAMMIARFKMFPEVKEKGMAALPRLIAFTSEHSHFSLK

SEQ ID NO: 316 - protein, 56 aa, Artificial; identical to SEQ ID NO: 292
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is N or Q for amidated amino acids
  MISC_FEATURE (18)..(18): X is M or Nle
  MISC_FEATURE (19)..(19): X is F, W or Y for aromatic amino acids
  MISC_FEATURE (20)..(20): X is A or G
  MISC_FEATURE (21)..(21): X is M or Nle
  MISC_FEATURE (22)..(22): X is M or Nle
  MISC_FEATURE (23)..(23): X is I, L or V
  MISC_FEATURE (24)..(24): X is A or G
  MISC_FEATURE (25)..(25): X is K, R or H for basic amino acids
  MISC_FEATURE (26)..(26): X is F, W or Y for aromatic amino acids
  MISC_FEATURE (27)..(27): X is K, R or H for basic amino acids
  MISC_FEATURE (28)..(28): X is M or Nle
  MISC_FEATURE (29)..(29): X is F, W or Y for aromatic amino acids
  MISC_FEATURE (30)..(30): X is F or P
  MISC_FEATURE (31)..(31): X is D and E for acidic amino acids
  MISC_FEATURE (32)..(32): X is I, L or V
  MISC_FEATURE (33)..(33): X is K, R or H for basic amino acids
  MISC_FEATURE (34)..(34): X is D and E for acidic amino acids
  MISC_FEATURE (35)..(35): X is K, R or H for basic amino acids
  MISC_FEATURE (36)..(36): X is A or G
  MISC_FEATURE (37)..(37): X is M or Nle
  MISC_FEATURE (38)..(38): X is A or G
  MISC_FEATURE (39)..(39): X is A or G
  MISC_FEATURE (40)..(40): X is I, L or V
  MISC_FEATURE (41)..(41): X is F or P
  MISC_FEATURE (42)..(42): X is K, R or H for basic amino acids
  MISC_FEATURE (43)..(43): X is I, L or V
  MISC_FEATURE (44)..(44): X is I, L or V
  MISC_FEATURE (45)..(45): X is A or G
  MISC_FEATURE (46)..(46): X is F, W or Y for aromatic amino acids
  MISC_FEATURE (47)..(47): X is T or S
  MISC_FEATURE (48)..(48): X is C or S
  MISC_FEATURE (49)..(49): X is D and E for acidic amino acids
  MISC_FEATURE (50)..(50): X is K, R or H for basic amino acids
  MISC_FEATURE (51)..(51): X is C or S
  MISC_FEATURE (52)..(52): X is K, R or H for basic amino acids
  MISC_FEATURE (53)..(53): X is F, W or Y for aromatic amino acids
  MISC_FEATURE (54)..(54): X is C or S
  MISC_FEATURE (55)..(55): X is I, L or V
  MISC_FEATURE (56)..(56): X is K, R or H for basic amino acids

SEQ ID NO: 317 - protein, 50 aa, Artificial [sequence omitted]

SEQ ID NO: 318 - protein, 50 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is I, L or V
  MISC_FEATURE (18)..(18): X is A or G
  MISC_FEATURE (19)..(19): X is K, R or H for basic amino acids
  MISC_FEATURE (20)..(20): X is F, W or Y for aromatic amino acids
  MISC_FEATURE (21)..(21): X is K, R or H for basic amino acids
  MISC_FEATURE (22)..(22): X is M or Nle
  MISC_FEATURE (23)..(23): X is F, W or Y for aromatic amino acid
  MISC_FEATURE (24)..(24): X is F or P
  MISC_FEATURE (25)..(25): X is D and E for acidic amino acids
  MISC_FEATURE (26)..(26): X is I, L or V
  MISC_FEATURE (27)..(27): X is K, R or H for basic amino acids
  MISC_FEATURE (28)..(28): X is D and E for acidic amino acids
  MISC_FEATURE (29)..(29): X is K, R or H for basic amino acids
  MISC_FEATURE (30)..(30): X is A or G
  MISC_FEATURE (31)..(31): X is M or Nle
  MISC_FEATURE (32)..(32): X is A or G
  MISC_FEATURE (33)..(33): X is A or G
  MISC_FEATURE (34)..(34): X is I, L or V
  MISC_FEATURE (35)..(35): X is F or P
  MISC_FEATURE (36)..(36): X is K, R or H for basic amino acids
  MISC_FEATURE (37)..(37): X is I, L or V
  MISC_FEATURE (38)..(38): X is I, L or V
  MISC_FEATURE (39)..(39): X is A or G
  MISC_FEATURE (40)..(40): X is F, W or Y for aromatic amino acids
  MISC_FEATURE (41)..(41): X is T or S
  MISC_FEATURE (42)..(42): X is C or S
  MISC_FEATURE (43)..(43): X is D and E for acidic amino acids
  MISC_FEATURE (44)..(44): X is K, R or H for basic amino acids
  MISC_FEATURE (45)..(45): X is C or S
  MISC_FEATURE (46)..(46): X is K, R or H for basic amino acids
  MISC_FEATURE (47)..(47): X is F, W or Y for aromatic amino acids
  MISC_FEATURE (48)..(48): X is C or S
  MISC_FEATURE (49)..(49): X is I, L or V
  MISC_FEATURE (50)..(50): X is K, R or H for basic amino acids
XXXXXXXXXXXXXXXXXXXXXXXXXXXXXXXXXXXXXXXXXXXXXXXXXX

SEQ ID NO: 319 - protein, 36 aa, Artificial
  Completely synthesized peptide construct
DLLKNGERIEKVEGGGSRLSKVAPVIKARMMEYGTT

SEQ ID NO: 320 - protein, 36 aa, Artificial; identical to SEQ ID NO: 164
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acid amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is C or S
  MISC_FEATURE (18)..(18): X is K, R or H for basic amino acids
  MISC_FEATURE (19)..(19): X is I, L or V
  MISC_FEATURE (20)..(20): X is C or S
  MISC_FEATURE (21)..(21): X is K, R or H for basic amino acids
  MISC_FEATURE (22)..(22): X is I, L or V
  MISC_FEATURE (23)..(23): X is A or G
  MISC_FEATURE (24)..(24): X is F or P
  MISC_FEATURE (25)..(25): X is I, L or V
  MISC_FEATURE (26)..(26): X is I, L or V
  MISC_FEATURE (27)..(27): X is K, R or H for basic amino acids
  MISC_FEATURE (28)..(28): X is A or G
  MISC_FEATURE (29)..(29): X is K, R or H for basic amino acids
  MISC_FEATURE (30)..(30): X is M or Nle
  MISC_FEATURE (31)..(31): X is M or Nle
  MISC_FEATURE (32)..(32): X is D and E for acidic amino acids
  MISC_FEATURE (33)..(33): X is F, W or Y for aromatic amino acids
  MISC_FEATURE (34)..(34): X is A or G
  MISC_FEATURE (35)..(35): X is T or S
  MISC_FEATURE (36)..(36): X is T or S

SEQ ID NO: 321 - protein, 35 aa, Artificial
  Completely synthesized peptide construct
DLKKNGERIEKVEGGGIPPSLRYLEDEERMSRLSK

SEQ ID NO: 322 - protein, 34 aa, Artificial; identical to SEQ ID NO: 77
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is I, L or V
  MISC_FEATURE (18)..(18): X is F or P
  MISC_FEATURE (19)..(19): X is F or P
  MISC_FEATURE (20)..(20): X is C or S
  MISC_FEATURE (21)..(21): X is I, L or V
  MISC_FEATURE (22)..(22): X is K, R or H for basic amino acids
  MISC_FEATURE (23)..(23): X is F, W or Y for aromatic amino acids
  MISC_FEATURE (24)..(24): X is D and E for acidic amino acids
  MISC_FEATURE (25)..(25): X is D and E for acidic amino acids
  MISC_FEATURE (26)..(26): X is D and E for acidic amino acids
  MISC_FEATURE (27)..(27): X is D and E for acidic amino acids
  MISC_FEATURE (28)..(28): X is K, R or H for basic amino acids
  MISC_FEATURE (29)..(29): X is M or Nle
  MISC_FEATURE (30)..(30): X is C or S
  MISC_FEATURE (31)..(31): X is K, R or H for basic amino acids
  MISC_FEATURE (32)..(32): X is I, L or V
  MISC_FEATURE (33)..(33): X is C or S
  MISC_FEATURE (34)..(34): X is K, R or H for basic amino acids

SEQ ID NO: 323 - protein, 35 aa, Artificial
  Completely synthesized peptide construct
DLKNGERIEKVEGGGNTNMFTYEIAPVFVLLEYVT

SEQ ID NO: 324 - protein, 36 aa, Artificial; identical to SEQ ID NO: 164
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K,  R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is N or Q for amidated amino acids
  MISC_FEATURE (18)..(18): X is T or S
  MISC_FEATURE (19)..(19): X is N or Q for amidated amino acids
  MISC_FEATURE (20)..(20): X is M or Nle
  MISC_FEATURE (21)..(21): X is F, W or Y for aromatic amino acids
  MISC_FEATURE (22)..(22): X is T or S
  MISC_FEATURE (23)..(23): X is F, W or Y for aromatic amino acids
  MISC_FEATURE (24)..(24): X is D and E for acidic amino acids
  MISC_FEATURE (25)..(25): X is I, L or V
  MISC_FEATURE (26)..(26): X is A or G
  MISC_FEATURE (27)..(27): X is F or P
  MISC_FEATURE (28)..(28): X is I, L or V
  MISC_FEATURE (29)..(29): X is F, W or Y for aromatic amino acids
  MISC_FEATURE (30)..(30): X is I, L or V
  MISC_FEATURE (31)..(31): X is I, L or V
  MISC_FEATURE (32)..(32): X is I, L or V
  MISC_FEATURE (33)..(33): X is D and E for acidic amino acids
  MISC_FEATURE (34)..(34): X is F, W or Y for aromatic amino acids
  MISC_FEATURE (35)..(35): X is I, L or V
  MISC_FEATURE (36)..(36): X is T or S

SEQ ID NO: 325 - protein, 31 aa, Artificial
  Completely synthesized peptide construct
DLLKNGERIEKVEGGGFKADEKKFWGKYLYE

SEQ ID NO: 326 - protein, 31 aa, Artificial; identical to SEQ ID NO: 123
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is F, Wor Y for aromatic amino acids
  MISC_FEATURE (18)..(18): X is K, R or H for basic amino acids
  MISC_FEATURE (19)..(19): X is A or G
  MISC_FEATURE (20)..(20): X is D and E for acidic amino acids
  MISC_FEATURE (21)..(21): X is D and E for acidic amino acids
  MISC_FEATURE (22)..(22): X is K, R or  H for basic amino acids
  MISC_FEATURE (23)..(23): X is K, R or H for basic amino acids
  MISC_FEATURE (24)..(24): X is F, W or Y for aromatic amino acids
  MISC_FEATURE (25)..(25): X is F,  W or Y for aromatic amino acids
  MISC_FEATURE (26)..(26): X is A or G
  MISC_FEATURE (27)..(27): X is K, R or H for basic amino acids
  MISC_FEATURE (28)..(28): X is F,  W or Y for aromatic amino acids
  MISC_FEATURE (29)..(29): X is I, L or V
  MISC_FEATURE (30)..(30): X is F, W or Y for aromatic amino acids
  MISC_FEATURE (31)..(31): X is D and E for acidic amino acids

SEQ ID NO: 327 - protein, 31 aa, Artificial
  Completely synthesized peptide construct
DLKKNGERIEKVEGGGSHLVEALYLVCGERG

SEQ ID NO: 328 - protein, 30 aa, Artificial; identical to SEQ ID NO: 56
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K,  R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is C or S
  MISC_FEATURE (18)..(18): X is K, R or H for basic amino acids
  MISC_FEATURE (19)..(19): X is I, L or V
  MISC_FEATURE (20)..(20): X is I, L or V
  MISC_FEATURE (21)..(21): X is D and E for acidic amino acids
  MISC_FEATURE (22)..(22): X is A or G
  MISC_FEATURE (23)..(23): X is I, L or V
  MISC_FEATURE (24)..(24): X is F, W or Y for aromatic amino acids
  MISC_FEATURE (25)..(25): X is I, L or V
  MISC_FEATURE (26)..(26): X is C or S
  MISC_FEATURE (27)..(27): X is A or G
  MISC_FEATURE (28)..(28): X is D and E for acidic amino acids
  MISC_FEATURE (29)..(29): X is K, R or H for basic amino acids
  MISC_FEATURE (30)..(30): X is A or G

SEQ ID NO: 329 - protein, 39 aa, Artificial
  Completely synthesized peptide construct
DLKNGERIEKVEGGGVLGGGCALLRCIPALDSLTPANED

SEQ ID NO: 330 - protein, 40 aa, Artificial; identical to SEQ ID NO: 52
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is I, L or V
  MISC_FEATURE (18)..(18): X is I, L or V
  MISC_FEATURE (19)..(19): X is A or G
  MISC_FEATURE (20)..(20): X is A or G
  MISC_FEATURE (21)..(21): X is A or G
  MISC_FEATURE (22)..(22): X is C or S
  MISC_FEATURE (23)..(23): X is A or G
  MISC_FEATURE (24)..(24): X is I, L or V
  MISC_FEATURE (25)..(25): X is I, L or V
  MISC_FEATURE (26)..(26): X is K, R or H for basic amino acids
  MISC_FEATURE (27)..(27): X is C or S
  MISC_FEATURE (28)..(28): X is I, L or V
  MISC_FEATURE (29)..(29): X is  F or P
  MISC_FEATURE (30)..(30): X is A or G
  MISC_FEATURE (31)..(31): X is I, L or V
  MISC_FEATURE (32)..(32): X is D and E for acidic amino acids
  MISC_FEATURE (33)..(33): X is C or S
  MISC_FEATURE (34)..(34): X is I, L or V
  MISC_FEATURE (35)..(35): X is T or S
  MISC_FEATURE (36)..(36): X is F or P
  MISC_FEATURE (37)..(37): X is A or G
  MISC_FEATURE (38)..(38): X is N or Q for amidated amino acids
  MISC_FEATURE (39)..(39): X is D and E for acidic amino acids
  MISC_FEATURE (40)..(40): X is D and E for acidic amino acids

SEQ ID NO: 331 - protein, 44 aa, Artificial
  Completely synthesized peptide construct
DLLKNGERIEKVEGGGEACVTSWLWSGEGAVFYRVDLHFINLGT

SEQ ID NO: 332 - protein, 44 aa, Artificial; identical to SEQ ID NO: 294
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is F, W or Y for aromatic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is D and E for acidic amino acids
  MISC_FEATURE (18)..(18): X is A or G
  MISC_FEATURE (19)..(19): X is C or S
  MISC_FEATURE (20)..(20): X is I, L or V
  MISC_FEATURE (21)..(21): X is T or S
  MISC_FEATURE (22)..(22): X is C or S
  MISC_FEATURE (23)..(23): X is F, W or Y for aromatic amino acids
  MISC_FEATURE (24)..(24): X is I, L or V
  MISC_FEATURE (25)..(25): X is F, W or Y for aromatic amino acids
  MISC_FEATURE (26)..(26): X is C or S
  MISC_FEATURE (27)..(27): X is A or G
  MISC_FEATURE (28)..(28): X is D and E for acidic amino acids
  MISC_FEATURE (29)..(29): X is A or G
  MISC_FEATURE (30)..(30): X is A or G
  MISC_FEATURE (31)..(31): X is I, L or V
  MISC_FEATURE (32)..(32): X is F, W or Y for aromatic amino acids
  MISC_FEATURE (33)..(33): X is F, W or Y for aromatic amino acids
  MISC_FEATURE (34)..(34): X is K, R or H for basic amino acids
  MISC_FEATURE (35)..(35): X is I, L or V
  MISC_FEATURE (36)..(36): X is D and  E for acidic amino acids
  MISC_FEATURE (37)..(37): X is I, L or V
  MISC_FEATURE (38)..(38): X is K, R or H for basic amino acids
  MISC_FEATURE (39)..(39): X is F, W or Y for aromatic amino acids
  MISC_FEATURE (40)..(40): X is I, L or V
  MISC_FEATURE (41)..(41): X is N or Q for amidated amino acids
  MISC_FEATURE (42)..(42): X is I, L or V
  MISC_FEATURE (43)..(43): X is A or G
  MISC_FEATURE (44)..(44): X is T or S

SEQ ID NO: 333 - protein, 36 aa, Artificial
  Completely synthesized peptide construct
DLKNGERIEKVEGGGMDFWCVEHDRPPPATPTSLTT

SEQ ID NO: 334 - protein, 37 aa, Artificial; identical to SEQ ID NO: 151
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K,  R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is M or Nle
  MISC_FEATURE (18)..(18): X is D and E for acidic amino acids
  MISC_FEATURE (19)..(19): X is F, W or Y for aromatic amino acids
  MISC_FEATURE (20)..(20): X is F, W or Y for aromatic amino acids
  MISC_FEATURE (21)..(21): X is C or S
  MISC_FEATURE (22)..(22): X is I, L or V
  MISC_FEATURE (23)..(23): X is D and E for acidic amino acids
  MISC_FEATURE (24)..(24): X is K, R or H for basic amino acids
  MISC_FEATURE (25)..(25): X is D and E for acidic amino acids
  MISC_FEATURE (26)..(26): X is K, R or H for basic amino acids
  MISC_FEATURE (27)..(27): X is F or P
  MISC_FEATURE (28)..(28): X is F or P
  MISC_FEATURE (29)..(29): X is F or P
  MISC_FEATURE (30)..(30): X is A or G
  MISC_FEATURE (31)..(31): X is T or S
  MISC_FEATURE (32)..(32): X is F or P
  MISC_FEATURE (33)..(33): X  is T or S
  MISC_FEATURE (34)..(34): X is C or S
  MISC_FEATURE (35)..(35): X is I, L or V
  MISC_FEATURE (36)..(36): X is T or S
  MISC_FEATURE (37)..(37): X is T or S

SEQ ID NO: 335 - protein, 36 aa, Artificial
  Completely synthesized peptide construct
DLLKNGERIEKVEGGGNMYAMMIARFKMFPEVKEKG

SEQ ID NO: 336 - protein, 36 aa, Artificial; identical to SEQ ID NO: 164
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X  is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is N or Q for amidated amino acids
  MISC_FEATURE (18)..(18): X is M or Nle
  MISC_FEATURE (19)..(19): X is F, W or Y for aromatic amino acids
  MISC_FEATURE (20)..(20): X is A or G
  MISC_FEATURE (21)..(21): X is M or Nle
  MISC_FEATURE (22)..(22): X is M or Nle
  MISC_FEATURE (23)..(23): X is I, L or V
  MISC_FEATURE (24)..(24): X is A or G
  MISC_FEATURE (25)..(25): X is K, R or H for basic amino acids
  MISC_FEATURE (26)..(26): X  is F, W or Y for aromatic amino acids
  MISC_FEATURE (27)..(27): X is K, R or H for basic amino acids
  MISC_FEATURE (28)..(28): X is M or Nle
  MISC_FEATURE (29)..(29): X is F, W or Y for aromatic amino acids
  MISC_FEATURE (30)..(30): X is F or P
  MISC_FEATURE (31)..(31): X is D and E for acidic amino acids
  MISC_FEATURE (32)..(32): X is I, L or V
  MISC_FEATURE (33)..(33): X is K, R or H for basic amino acids
  MISC_FEATURE (34)..(34): X is D and E for acidic amino acids
  MISC_FEATURE (35)..(35): X is K, R or H for basic amino acids
  MISC_FEATURE (36)..(36): X is A or G

SEQ ID NO: 337 - protein, 49 aa, Artificial
  Completely synthesized peptide construct
DLLKNGERIEKVEGGGNMYAMMIARFKMFPEVKEKGMAALPRLIAFTSE

SEQ ID NO: 338 - protein, 49 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is N or Q for amidated amino acids
  MISC_FEATURE (18)..(18): X is M or Nle
  MISC_FEATURE (19)..(19): X is F, W or Y for aromatic amino acids
  MISC_FEATURE (20)..(20): X is A or G
  MISC_FEATURE (21)..(21): X is M or Nle
  MISC_FEATURE (22)..(22): X is M or Nle
  MISC_FEATURE (23)..(23): X is I, L or V
  MISC_FEATURE (24)..(24): X is A or G
  MISC_FEATURE (25)..(25): X is K, R or H for basic amino acids
  MISC_FEATURE (26)..(26): X is F, W or Y for aromatic amino acids
  MISC_FEATURE (27)..(27): X is K, R or H for basic amino acids
  MISC_FEATURE (28)..(28): X is M or Nle
  MISC_FEATURE (29)..(29): X is F, W or Y for aromatic amino acids
  MISC_FEATURE (30)..(30): X is F or P
  MISC_FEATURE (31)..(31): X is D and E for acidic amino acids
  MISC_FEATURE (32)..(32): X is I, L or V
  MISC_FEATURE (33)..(33): X is K, R or H for basic amino acids
  MISC_FEATURE (34)..(34): X is D and E for acidic amino acids
  MISC_FEATURE (35)..(35): X is K, R or H for basic amino acids
  MISC_FEATURE (36)..(36): X is A or G
  MISC_FEATURE (37)..(37): X is M or Nle
  MISC_FEATURE (38)..(38): X is A or G
  MISC_FEATURE (39)..(39): X is A or G
  MISC_FEATURE (40)..(40): X is I, L or V
  MISC_FEATURE (41)..(41): X is F or P
  MISC_FEATURE (42)..(42): X is K, R or H for basic amino acids
  MISC_FEATURE (43)..(43): X is I, L or V
  MISC_FEATURE (44)..(44): X is I, L or V
  MISC_FEATURE (45)..(45): X is A or G
  MISC_FEATURE (46)..(46): X is F,  W or Y for aromatic amino acids
  MISC_FEATURE (47)..(47): X is T or S
  MISC_FEATURE (48)..(48): X is C or S
  MISC_FEATURE (49)..(49): X is D and E for acidic amino acids
XXXXXXXXXXXXXXXXXXXXXXXXXXXXXXXXXXXXXXXXXXXXXXXXX

SEQ ID NO: 339 - protein, 29 aa, Artificial
  Completely synthesized peptide construct
DLLKNGERIEKVEGGGIAFTSEHSHFSLK

SEQ ID NO: 340 - protein, 29 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidateda mino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is I, L or V
  MISC_FEATURE (18)..(18): X is A or G
  MISC_FEATURE (19)..(19): X is F, W or Y for aromatic amino acids
  MISC_FEATURE (20)..(20): X is T or S
  MISC_FEATURE (21)..(21): X is C or S
  MISC_FEATURE (22)..(22): X is D and E for acidic amino acids
  MISC_FEATURE (23)..(23): X is K,  R or H for basic amino acids
  MISC_FEATURE (24)..(24): X is C or S
  MISC_FEATURE (25)..(25): X is K, R or H for basic amino acids
  MISC_FEATURE (26)..(26): X is F, W or Y for aromatic amino acids
  MISC_FEATURE (27)..(27): X is C or S
  MISC_FEATURE (28)..(28): X is I, L or V
  MISC_FEATURE (29)..(29): X is K,R or H for basic amino acids
XXXXXXXXXXXXXXXXXXXXXXXXXXXXX

SEQ ID NO: 341 - protein, 37 aa, Artificial
  Completely synthesized peptide construct
DLLKNGERIEKVEGGGMDFWCVEHDRPPPATPTSLTT

SEQ ID NO: 342 - protein, 37 aa, Artificial; identical to SEQ ID NO: 151
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is M or Nle
  MISC_FEATURE (18)..(18): X is D and E for acidic amino acids
  MISC_FEATURE (19)..(19): X is F, W or Y for aromatic amino acids
  MISC_FEATURE (20)..(20): X is F, W or Y for aromatic amino acids
  MISC_FEATURE (21)..(21): X is C or S
  MISC_FEATURE (22)..(22): X is I, L or V
  MISC_FEATURE (23)..(23): X is D and  E for acidic amino acids
  MISC_FEATURE (24)..(24): X is K, R or H for basic amino acids
  MISC_FEATURE (25)..(25): X is D and E for acidic amino acids
  MISC_FEATURE (26)..(26): X is K, R or H for basic amino acids
  MISC_FEATURE (27)..(27): X is F  or P
  MISC_FEATURE (28)..(28): X is F  or P
  MISC_FEATURE (29)..(29): X is F  or P
  MISC_FEATURE (30)..(30): X is A or G
  MISC_FEATURE (31)..(31): X is T or S
  MISC_FEATURE (32)..(32): X is F or P
  MISC_FEATURE (33)..(33): X is T or S
  MISC_FEATURE (34)..(34): X is C or S
  MISC_FEATURE (35)..(35): X is I, L or V
  MISC_FEATURE (36)..(36): X is T or S
  MISC_FEATURE (37)..(37): X is T or S

SEQ ID NO: 343 - protein, 26 aa, Artificial
  Completely synthesized peptide construct
DLLKNGERIEKVEGGGERPTLAFLQD

SEQ ID NO: 344 - protein, 26 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is D and E for acidic amino acids
  MISC_FEATURE (18)..(18): X is K, R or H for basic amino acids
  MISC_FEATURE (19)..(19): X is F or P
  MISC_FEATURE (20)..(20): X is T or S
  MISC_FEATURE (21)..(21): X is I, L or V
  MISC_FEATURE (22)..(22): X is A or G
  MISC_FEATURE (23)..(23): X is F, W or Y for aromatic amino acids
  MISC_FEATURE (24)..(24): X is I, L or V
  MISC_FEATURE (25)..(25): X is N or Q for amidated amino acids
  MISC_FEATURE (26)..(26): X is D and E for acidic amino acids
XXXXXXXXXXXXXXXXXXXXXXXXXX

SEQ ID NO: 345 - protein, 26 aa, Artificial
  Completely synthesized peptide construct
DLLKNGERIEKVEGGGDRSTKVIDFH

SEQ ID NO: 346 - protein, 26 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is D and E for acidic amino acids
  MISC_FEATURE (18)..(18): X is K, R or H for basic amino acids
  MISC_FEATURE (19)..(19): X is C or S
  MISC_FEATURE (20)..(20): X is T or S
  MISC_FEATURE (21)..(21): X is K, R or H for basic amino acids
  MISC_FEATURE (22)..(22): X is I, L or V
  MISC_FEATURE (23)..(23): X is I, L or V
  MISC_FEATURE (24)..(24): X is D and E for acidic amino acids
  MISC_FEATURE (25)..(25): X is F, W or Y for aromatic amino acids
  MISC_FEATURE (26)..(26): X is K, R or H for basic amino acids
XXXXXXXXXXXXXXXXXXXXXXXXXX

SEQ ID NO: 347 - protein, 29 aa, Artificial
  Completely synthesized peptide construct
DLLKNGERIEKVEGGGIAGFKGEQGPKGE

SEQ ID NO: 348 - protein, 29 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is I, L or V
  MISC_FEATURE (18)..(18): X is A or G
  MISC_FEATURE (19)..(19): X is A or G
  MISC_FEATURE (20)..(20): X is F, W or Y for aromatic amino acids
  MISC_FEATURE (21)..(21): X is K, R or H for basic amino acids
  MISC_FEATURE (22)..(22): X is A or G
  MISC_FEATURE (23)..(23): X is D and E for acidic amino acids
  MISC_FEATURE (24)..(24): X is N or Q for amidated amino acids
  MISC_FEATURE (25)..(25): X is A or G
  MISC_FEATURE (26)..(26): X is F or P
  MISC_FEATURE (27)..(27): X is K, R or H for basic amino acids
  MISC_FEATURE (28)..(28): X is A or G
  MISC_FEATURE (29)..(29): X is D and E for acidic amino acids
XXXXXXXXXXXXXXXXXXXXXXXXXXXXX

SEQ ID NO: 349 - protein, 16 aa, Artificial
  Completely synthesized peptide construct
DLLKNGERIEKVEGGG

SEQ ID NO: 350 - protein, 16 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
XXXXXXXXXXXXXXXX

SEQ ID NO: 351 - protein, 24 aa, Artificial
  Completely synthesized peptide construct
DLLKNGERIEKVEGGGKNIVTPRT

SEQ ID NO: 352 - protein, 24 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is K, R or H for basic amino acids
  MISC_FEATURE (18)..(18): X is N or Q for amidated amino acids
  MISC_FEATURE (19)..(19): X is I, L or V
  MISC_FEATURE (20)..(20): X is I, L or V
  MISC_FEATURE (21)..(21): X is T or S
  MISC_FEATURE (22)..(22): X is F or P
  MISC_FEATURE (23)..(23): X is K, R or H for basic amino acids
  MISC_FEATURE (24)..(24): X is T or S
XXXXXXXXXXXXXXXXXXXXXXXX

SEQ ID NO: 353 - protein, 31 aa, Artificial
  Completely synthesized peptide construct
DLLKNGERIEKVEGGGGDKVSFFCKNKEKKC

SEQ ID NO: 354 - protein, 31 aa, Artificial; identical to SEQ ID NO: 123
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is A or G
  MISC_FEATURE (18)..(18): X is D and E for acidic amino acids
  MISC_FEATURE (19)..(19): X is K, R or H for basic amino acids
  MISC_FEATURE (20)..(20): X is I, L or V
  MISC_FEATURE (21)..(21): X is C or S
  MISC_FEATURE (22)..(22): X is F, W or Y for aromatic amino acids
  MISC_FEATURE (23)..(23): X is F, W or Y for aromatic amino acids
  MISC_FEATURE (24)..(24): X is C or S
  MISC_FEATURE (25)..(25): X is K, R or H for basic amino acids
  MISC_FEATURE (26)..(26): X is N or Q for aromatic amino acids
  MISC_FEATURE (27)..(27): X is K, R or H for basic amino acids
  MISC_FEATURE (28)..(28): X is D and E for acidic amino acids
  MISC_FEATURE (29)..(29): X is K, R or H for basic amino acids
  MISC_FEATURE (30)..(30): X is K, R or H for basic amino acids
  MISC_FEATURE (31)..(31): X is C or S

SEQ ID NO: 355 - protein, 33 aa, Artificial
  Completely synthesized peptide construct
DLLKNGERIEKVEGGGEIIVTHFPFDEQNCSMK

SEQ ID NO: 356 - protein, 33 aa, Artificial; identical to SEQ ID NO: 97
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is D and E for acidic amino acids
  MISC_FEATURE (18)..(18): X is I, L or V
  MISC_FEATURE (19)..(19): X is I, L or V
  MISC_FEATURE (20)..(20): X is I, L or V
  MISC_FEATURE (21)..(21): X is T or S
  MISC_FEATURE (22)..(22): X is K, R or H for basic amino acids
  MISC_FEATURE (23)..(23): X is F, W or Y for aromatic amino acids
  MISC_FEATURE (24)..(24): X is F or P
  MISC_FEATURE (25)..(25): X is F, W or Y for aromatic amino acids
  MISC_FEATURE (26)..(26): X is D and E for acidic amino acids
  MISC_FEATURE (27)..(27): X is D and E for acidic amino acids
  MISC_FEATURE (28)..(28): X is N or Q for aromatic amino acids
  MISC_FEATURE (29)..(29): X is N or Q for aromatic amino acids
  MISC_FEATURE (30)..(30): X is C or S
  MISC_FEATURE (31)..(31): X is C or S
  MISC_FEATURE (32)..(32): X is M or Nle
  MISC_FEATURE (33)..(33): X is K, R or H for basic amino acids

SEQ ID NO: 357 - protein, 29 aa, Artificial
  Completely synthesized peptide construct
DLLKNGERIEKVEGGGVHFFKNIVTPRTP

SEQ ID NO: 358 - protein, 29 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is I, L or V
  MISC_FEATURE (18)..(18): X is K, R or H for basic amino acids
  MISC_FEATURE (19)..(19): X is F, W or Y for aromatic amino acids
  MISC_FEATURE (20)..(20): X is F, W or Y for aromatic amino acids
  MISC_FEATURE (21)..(21): X is K, R or H for basic amino acids
  MISC_FEATURE (22)..(22): X is N or Q for amidated amino acids
  MISC_FEATURE (23)..(23): X is I, L or V
  MISC_FEATURE (24)..(24): X is I,  L or V
  MISC_FEATURE (25)..(25): X is T or S
  MISC_FEATURE (26)..(26): X is F or P
  MISC_FEATURE (27)..(27): X is K, R or H for basic amino acids
  MISC_FEATURE (28)..(28): X is T or S
  MISC_FEATURE (29)..(29): X is F or P
XXXXXXXXXXXXXXXXXXXXXXXXXXXXX

SEQ ID NO: 359 - protein, 33 aa, Artificial
  Completely synthesized peptide construct
DLLKNGERIEKVEGGGYQQLNSERGVPNENIEN

SEQ ID NO: 360 - protein, 33 aa, Artificial; identical to SEQ ID NO: 97
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is F, W or Y for aromatic amino acids
  MISC_FEATURE (18)..(18): X is N or Q for aromatic amino acids
  MISC_FEATURE (19)..(19): X is N or Q for amidated amino acids
  MISC_FEATURE (20)..(20): X is I, L or V
  MISC_FEATURE (21)..(21): X is N or Q for amidated amino acids
  MISC_FEATURE (22)..(22): X is C or S
  MISC_FEATURE (23)..(23): X is D and E for acidic amino acids
  MISC_FEATURE (24)..(24): X is K, R or H for basic amino acids
  MISC_FEATURE (25)..(25): X is A or G
  MISC_FEATURE (26)..(26): X is I, L or V
  MISC_FEATURE (27)..(27): X is F or P
  MISC_FEATURE (28)..(28): X is N or Q for amidated amino acids
  MISC_FEATURE (29)..(29): X is D and E for acidic amino acids
  MISC_FEATURE (30)..(30): X is N or Q for amidated amino acids
  MISC_FEATURE (31)..(31): X is I, L or V
  MISC_FEATURE (32)..(32): X is D and E for acidic amino acids
  MISC_FEATURE (33)..(33): X is N or Q for amidated amino acids

SEQ ID NO: 361 - protein, 29 aa, Artificial
  Completely synthesized peptide construct
DLLKNGERIEKVEGGGVFIKRVSNVIIHG

SEQ ID NO: 362 - protein, 29 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is I, L or V
  MISC_FEATURE (18)..(18): X is F, W or Y for aromatic amino acids
  MISC_FEATURE (19)..(19): X is I, L or V
  MISC_FEATURE (20)..(20): X is K, R or H for basic amino acids
  MISC_FEATURE (21)..(21): X is K, R or H for basic amino acids
  MISC_FEATURE (22)..(22): X is I, L or V
  MISC_FEATURE (23)..(23): X is C or S
  MISC_FEATURE (24)..(24): X is N or Q for amidated amino acids
  MISC_FEATURE (25)..(25): X is I, L or V
  MISC_FEATURE (26)..(26): X is I, L or V
  MISC_FEATURE (27)..(27): X is I, L or V
  MISC_FEATURE (28)..(28): X is K, R or H for basic amino acids
  MISC_FEATURE (29)..(29): X is A or G
XXXXXXXXXXXXXXXXXXXXXXXXXXXXX

SEQ ID NO: 363 - protein, 31 aa, Artificial
  Completely synthesized peptide construct
DLLKNGERIEKVEGGGMKVTVAFNQFGPNRR

SEQ ID NO: 364 - protein, 31 aa, Artificial; identical to SEQ ID NO: 123
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is M or Nle
  MISC_FEATURE (18)..(18): X is K, R or H for basic amino acids
  MISC_FEATURE (19)..(19): X is I,  L or V
  MISC_FEATURE (20)..(20): X is T or S
  MISC_FEATURE (21)..(21): X is I, L or V
  MISC_FEATURE (22)..(22): X is A or G
  MISC_FEATURE (23)..(23): X is F, W or Y for aromatic amino acids
  MISC_FEATURE (24)..(24): X is N or Q for amidated amino acids
  MISC_FEATURE (25)..(25): X is N or Q for amidated amino acids
  MISC_FEATURE (26)..(26): X is F, W or Y for aromatic amino acids
  MISC_FEATURE (27)..(27): X is A or G
  MISC_FEATURE (28)..(28): X is F or P
  MISC_FEATURE (29)..(29): X is N or Q for amidated amino acids
  MISC_FEATURE (30)..(30): X is K, R or H for basic amino acids
  MISC_FEATURE (31)..(31): X is K, R or H for basic amino acids

SEQ ID NO: 365 - protein, 31 aa, Artificial
  Completely synthesized peptide construct
DLLKNGERIEKVEGGGIASRRVDGIIAAYQN

SEQ ID NO: 366 - protein, 31 aa, Artificial; identical to SEQ ID NO: 123
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is I, L or V
  MISC_FEATURE (18)..(18): X is A or G
  MISC_FEATURE (19)..(19): X is C or S
  MISC_FEATURE (20)..(20): X is K, R or H for basic amino acids
  MISC_FEATURE (21)..(21): X is K, R or H for basic amino acids
  MISC_FEATURE (22)..(22): X is I, L or V
  MISC_FEATURE (23)..(23): X is D and E for acidic amino acids
  MISC_FEATURE (24)..(24): X is A or G
  MISC_FEATURE (25)..(25): X is I, L or V
  MISC_FEATURE (26)..(26): X is I, L or V
  MISC_FEATURE (27)..(27): X is A or G
  MISC_FEATURE (28)..(28): X is A or G
  MISC_FEATURE (29)..(29): X is F, W or Y for aromatic amino acids
  MISC_FEATURE (30)..(30): X is N or Q for aromatic amino acids
  MISC_FEATURE (31)..(31): X is N or Q for aromatic amino acids

SEQ ID NO: 367 - protein, 35 aa, Artificial
  Completely synthesized peptide construct
DLLKNGERIEKVEGGGIDIFASKNFHLQKNTIGTG

SEQ ID NO: 368 - protein, 35 aa, Artificial; identical to SEQ ID NO: 197
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is I, L or V
  MISC_FEATURE (18)..(18): X is D and E for acidic amino acids
  MISC_FEATURE (19)..(19): X is I, L or V
  MISC_FEATURE (20)..(20): X is F, W or Y for aromatic amino acids
  MISC_FEATURE (21)..(21): X is A or G
  MISC_FEATURE (22)..(22): X is C or S
  MISC_FEATURE (23)..(23): X is K, R or H for basic amino acids
  MISC_FEATURE (24)..(24): X is N or Q for amidated amino acids
  MISC_FEATURE (25)..(25): X is F, W or Y for aromatic amino acids
  MISC_FEATURE (26)..(26): X is K, R or H for basic amino acids
  MISC_FEATURE (27)..(27): X is I, L or V
  MISC_FEATURE (28)..(28): X is N or Q for amidated amino acids
  MISC_FEATURE (29)..(29): X is K, R or H for basic amino acids
  MISC_FEATURE (30)..(30): X is N or Q for amidated amino acids
  MISC_FEATURE (31)..(31): X is T or S
  MISC_FEATURE (32)..(32): X is I, L or V
  MISC_FEATURE (33)..(33): X is A or G
  MISC_FEATURE (34)..(34): X is T or S
  MISC_FEATURE (35)..(35): X is A or G

SEQ ID NO: 369 - protein, 41 aa, Artificial
  Completely synthesized peptide construct
DLLKNGERIEKVEGGGGIGAVLKVLTTGPALISWIKRKRQQ

SEQ ID NO: 370 - protein, 41 aa, Artificial
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A or G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A or G
  MISC_FEATURE (15)..(15): X is A or G
  MISC_FEATURE (16)..(16): X is A or G
  MISC_FEATURE (17)..(17): X is A or G
  MISC_FEATURE (18)..(18): X is I, L or V
  MISC_FEATURE (19)..(19): X is A or G
  MISC_FEATURE (20)..(20): X is A or G
  MISC_FEATURE (21)..(21): X is I, L or V
  MISC_FEATURE (22)..(22): X is I, L or V
  MISC_FEATURE (23)..(23): X is K, R or H for basic amino acids
  MISC_FEATURE (24)..(24): X is I, L or V
  MISC_FEATURE (25)..(25): X is I, L or V
  MISC_FEATURE (26)..(26): X is T or S
  MISC_FEATURE (27)..(27): X is T or S
  MISC_FEATURE (28)..(28): X is A or G
  MISC_FEATURE (29)..(29): X is F or P
  MISC_FEATURE (30)..(30): X is A or G
  MISC_FEATURE (31)..(31): X is I, L or V
  MISC_FEATURE (32)..(32): X is I, L or V
  MISC_FEATURE (33)..(33): X is C or S
  MISC_FEATURE (34)..(34): X is F, W or Y for aromatic amino acids
  MISC_FEATURE (35)..(35): X is I, L or V
  MISC_FEATURE (36)..(36): X is K, R or H for basic amino acids
  MISC_FEATURE (37)..(37): X is K, R or H for basic amino acids
  MISC_FEATURE (38)..(38): X is K, R or H for basic amino acids
  MISC_FEATURE (39)..(39): X is K, R or H for basic amino acids
  MISC_FEATURE (40)..(40): X is N or Q for amidated amino acids
  MISC_FEATURE (41)..(41): X is N or Q for amidated amino acids
  MISC_FEATURE (41)..(41): X is N or Q for amidated amino acids
XXXXXXXXXXXXXXXXXXXXXXXXXXXXXXXXXXXXXXXXX

SEQ ID NO: 371 - protein, 56 aa, Artificial
  Completely synthesized peptide construct
DAEFRHDSGYEVHHQKLVFFAEDVGSNKGAIIGLMVGGVVGGGDLLKNGERIEKVE

SEQ ID NO: 372 - protein, 56 aa, Artificial; identical to SEQ ID NO: 292
  peptide construct
  MISC_FEATURE (1)..(1): X is D and E for acidic amino acids
  MISC_FEATURE (2)..(2): X is A or G
  MISC_FEATURE (3)..(3): X is D and  E for acidic amino acids
  MISC_FEATURE (4)..(4): X is F,  W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F, W or Y for aromatic amino acids
  MISC_FEATURE (11)..(11): X is D and E for acidic amino acids
  MISC_FEATURE (12)..(12): X is I, L or V
  MISC_FEATURE (13)..(13): X is K, R or H for basic amino acids
  MISC_FEATURE (14)..(14): X is K, R or H for basic amino acids
  MISC_FEATURE (15)..(15): X is N or Q for amidated amino acids
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is F, W or Y for aromatic amino acids
  MISC_FEATURE (20)..(20): X is F, W or Y for aromatic amino acids
  MISC_FEATURE (21)..(21): X is A or G
  MISC_FEATURE (22)..(22): X is D and E for acidic amino acids
  MISC_FEATURE (23)..(23): X is D and E for acidic amino acids
  MISC_FEATURE (24)..(24): X is I, L or V
  MISC_FEATURE (25)..(25): X is A or G
  MISC_FEATURE (26)..(26): X is C or S
  MISC_FEATURE (27)..(27): X is N or Q for amidated amino acids
  MISC_FEATURE (28)..(28): X is K, R or H for basic amino acids
  MISC_FEATURE (29)..(29): X is A or G
  MISC_FEATURE (30)..(30): X is A or G
  MISC_FEATURE (31)..(31): X is I, L or V
  MISC_FEATURE (32)..(32): X is I, L or V
  MISC_FEATURE (33)..(33): X is A or G
  MISC_FEATURE (34)..(34): X is I, L or V
  MISC_FEATURE (35)..(35): X is M or Nle
  MISC_FEATURE (36)..(36): X is I, L or V
  MISC_FEATURE (37)..(37): X is A or G
  MISC_FEATURE (38)..(38): X is A or G
  MISC_FEATURE (39)..(39): X is I, L or V
  MISC_FEATURE (40)..(40): X is I, L or V
  MISC_FEATURE (41)..(41): X is A and G
  MISC_FEATURE (42)..(42): X is A and G
  MISC_FEATURE (43)..(43): X is A and G
  MISC_FEATURE (44)..(44): X is D and E for acidic amino acids
  MISC_FEATURE (45)..(45): X is I, L or V
  MISC_FEATURE (46)..(46): X is I, L or V
  MISC_FEATURE (47)..(47): X is K, R or H for basic amino acids
  MISC_FEATURE (48)..(48): X is N or Q for amidated amino acids
  MISC_FEATURE (49)..(49): X is A and G
  MISC_FEATURE (50)..(50): X is D and E for acidic amino acids
  MISC_FEATURE (51)..(51): X is K, R or H for basic amino acids
  MISC_FEATURE (52)..(52): X is I, L or V
  MISC_FEATURE (53)..(53): X is D and E for acidic amino acids
  MISC_FEATURE (54)..(54): X is K, R or H for basic amino acids
  MISC_FEATURE (55)..(55): X is I, L or V
  MISC_FEATURE (56)..(56): X is D and E for acidic amino acids

SEQ ID NO: 373 - protein, 43 aa, Artificial
  Completely synthesized peptide construct
DAEFRHDSGYEVHHQKLVFFAENVGSNKGGDLLKNGERIEKVE

SEQ ID NO: 374 - protein, 44 aa, Artificial; identical to SEQ ID NO: 294
  peptide construct
  MISC_FEATURE (1)..(1): X is D and E for acidic amino acids
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F, W or Y for aromatic amino acids
  MISC_FEATURE (11)..(11): X is A and G
  MISC_FEATURE (12)..(12): X is A and G
  MISC_FEATURE (13)..(13): X is A and G
  MISC_FEATURE (14)..(14): X is D and E for acidic amino acids
  MISC_FEATURE (15)..(15): X is I, L or V
  MISC_FEATURE (16)..(16): X is K, R or H for basic amino acids
  MISC_FEATURE (17)..(17): X is K, R or H for basic amino acids
  MISC_FEATURE (18)..(18): X is N or Q for amidated amino acids
  MISC_FEATURE (19)..(19): X is K, R or H for basic amino acids
  MISC_FEATURE (20)..(20): X is I, L or V
  MISC_FEATURE (21)..(21): X is I, L or V
  MISC_FEATURE (22)..(22): X is F, W or Y for aromatic amino acids
  MISC_FEATURE (23)..(23): X is F, W or Y for aromatic amino acids
  MISC_FEATURE (24)..(24): X is A and G
  MISC_FEATURE (25)..(25): X is D and E for acidic amino acids
  MISC_FEATURE (26)..(26): X is D and E for acidic amino acids
  MISC_FEATURE (27)..(27): X is I, L or V
  MISC_FEATURE (28)..(28): X is A and G
  MISC_FEATURE (29)..(29): X is C or S
  MISC_FEATURE (30)..(30): X is N or Q for amidated amino acids
  MISC_FEATURE (31)..(31): X is K, R or H for basic amino acids
  MISC_FEATURE (32)..(32): X is D and E for acidic amino acids
  MISC_FEATURE (33)..(33): X is I, L or V
  MISC_FEATURE (34)..(34): X is I, L or V
  MISC_FEATURE (35)..(35): X is K, R or H for basic amino acids
  MISC_FEATURE (36)..(36): X is N or Q for amidated amino acids
  MISC_FEATURE (37)..(37): X is A and G
  MISC_FEATURE (38)..(38): X is D and E for acidic amino acids
  MISC_FEATURE (39)..(39): X is K, R or H for basic amino acids
  MISC_FEATURE (40)..(40): X is I, L or V
  MISC_FEATURE (41)..(41): X is D and E for acidic amino acids
  MISC_FEATURE (42)..(42): X is K, R or H for basic amino acids
  MISC_FEATURE (43)..(43): X is I, L or V
  MISC_FEATURE (44)..(44): X is D and E for acidic amino acids

SEQ ID NO: 375 - protein, 46 aa, Artificial
  Completely synthesized peptide construct
DAEFRHDSGYEVHHQKLVFFAENVGSNKAIGGGDLLKNGERIEKVE

SEQ ID NO: 376 - protein, 46 aa, Artificial; identical to SEQ ID NO: 137
  peptide construct
  MISC_FEATURE (1)..(1): X is D and E for acidic amino acids
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F, W or Y for aromatic amino acids
  MISC_FEATURE (11)..(11): X is D and E for acidic amino acids
  MISC_FEATURE (12)..(12): X is I, L or V
  MISC_FEATURE (13)..(13): X is K, R or H for basic amino acids
  MISC_FEATURE (14)..(14): X is K, R or H for basic amino acids
  MISC_FEATURE (15)..(15): X is N or Q for amidated amino acids
  MISC_FEATURE (16)..(16): X is K,  R or H for basic amino acids
  MISC_FEATURE (17)..(17): X is I, L or V
  MISC_FEATURE (18)..(18): X is I, L or V
  MISC_FEATURE (19)..(19): X is F, W or Y for aromatic amino acids
  MISC_FEATURE (20)..(20): X is F, W or Y for aromatic amino acids
  MISC_FEATURE (21)..(21): X is A or G
  MISC_FEATURE (22)..(22): X is D and E for acidic amino acids
  MISC_FEATURE (23)..(23): X is D and E for acidic amino acids
  MISC_FEATURE (24)..(24): X is I, L or V
  MISC_FEATURE (25)..(25): X is A or G
  MISC_FEATURE (26)..(26): X is C or S
  MISC_FEATURE (27)..(27): X is N or Q for amidated amino acids
  MISC_FEATURE (28)..(28): X is K, R or H for basic amino acids
  MISC_FEATURE (29)..(29): X is A or G
  MISC_FEATURE (30)..(30): X is I, L or V
  MISC_FEATURE (31)..(31): X is A and G
  MISC_FEATURE (32)..(32): X is A and G
  MISC_FEATURE (33)..(33): X is A and G
  MISC_FEATURE (34)..(34): X is D and E for acidic amino acids
  MISC_FEATURE (35)..(35): X is I, L or V
  MISC_FEATURE (36)..(36): X is I, L or V
  MISC_FEATURE (37)..(37): X is K, R or H for basic amino acids
  MISC_FEATURE (38)..(38): X is N or Q for amidated amino acids
  MISC_FEATURE (39)..(39): X is A and G
  MISC_FEATURE (40)..(40): X is D and E for acidic amino acids
  MISC_FEATURE (41)..(41): X is K, R or H for basic amino acids
  MISC_FEATURE (42)..(42): X is I, L or V
  MISC_FEATURE (43)..(43): X is D and E for acidic amino acids
  MISC_FEATURE (44)..(44): X is K, R or H for basic amino acids
  MISC_FEATURE (45)..(45): X is I, L or V
  MISC_FEATURE (46)..(46): X is D and E for acidic amino acids

SEQ ID NO: 377 - protein, 27 aa, Artificial
  Completely synthesized peptide construct
DAEFRHDSGYEGGGDLLKNGERIEKVE

SEQ ID NO: 378 - protein, 27 aa, Artificial
  peptide construct
  MISC_FEATURE (1)..(1): X is D and E for acidic amino acids
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F, W or Y for aromatic amino acids
  MISC_FEATURE (11)..(11): X is D and E for acidic amino acids
  MISC_FEATURE (12)..(12): X is A and G
  MISC_FEATURE (13)..(13): X is A and G
  MISC_FEATURE (14)..(14): X is A and G
  MISC_FEATURE (15)..(15): X is D and E for acidic amino acids
  MISC_FEATURE (16)..(16): X is I, L or V
  MISC_FEATURE (17)..(17): X is I, L or V
  MISC_FEATURE (18)..(18): X is K, R or H for basic amino acids
  MISC_FEATURE (19)..(19): X is N or Q for amidated amino acids
  MISC_FEATURE (20)..(20): X is A and G
  MISC_FEATURE (21)..(21): X is D and E for acidic amino acids
  MISC_FEATURE (22)..(22): X is K, R or H for basic amino acids
  MISC_FEATURE (23)..(23): X is I, L or V
  MISC_FEATURE (24)..(24): X is D and E for acidic amino acids
  MISC_FEATURE (25)..(25): X is K, R or H for basic amino acids
  MISC_FEATURE (26)..(26): X is I, L or V
  MISC_FEATURE (27)..(27): X is D and E for acidic amino acids
XXXXXXXXXXXXXXXXXXXXXXXXXXX

SEQ ID NO: 379 - protein, 23 aa, Artificial
  Completely synthesized peptide construct
ENVGSNKGGGDLLKNGERIEKVE

SEQ ID NO: 380 - protein, 23 aa, Artificial
  peptide construct
  MISC_FEATURE (1)..(1): X is D and E for acidic amino acids
  MISC_FEATURE (2)..(2): X is D and E for acidic amino acids
  MISC_FEATURE (3)..(3): X is I, L or V
  MISC_FEATURE (4)..(4): X is A or G
  MISC_FEATURE (5)..(5): X is C or S
  MISC_FEATURE (6)..(6): X is N or Q for amidated amino acids
  MISC_FEATURE (7)..(7): X is K, R or H for basic amino acids
  MISC_FEATURE (8)..(8): X is A and G
  MISC_FEATURE (9)..(9): X is A and G
  MISC_FEATURE (10)..(10): X is A and G
  MISC_FEATURE (11)..(11): X is D and E for acidic amino acids
  MISC_FEATURE (12)..(12): X is I, L or V
  MISC_FEATURE (13)..(13): X is I, L or V
  MISC_FEATURE (14)..(14): X is K, R or H for basic amino acids
  MISC_FEATURE (15)..(15): X is N or Q for amidated amino acids
  MISC_FEATURE (16)..(16): X is A and G
  MISC_FEATURE (17)..(17): X is D and E for acidic amino acids
  MISC_FEATURE (18)..(18): X is K, R or H for basic amino acids
  MISC_FEATURE (19)..(19): X is I, L or V
  MISC_FEATURE (20)..(20): X is D and E for acidic amino acids
  MISC_FEATURE (21)..(21): X is K, R or H for basic amino acids
  MISC_FEATURE (22)..(22): X is I, L or V
  MISC_FEATURE (23)..(23): X is D and E for acidic amino acids
XXXXXXXXXXXXXXXXXXXXXXX

SEQ ID NO: 381 - protein, 28 aa, Artificial
  Completely synthesized peptide construct
DAEFRHDSGYEVGGGDLLKNGERIEKVE

SEQ ID NO: 382 - protein, 28 aa, Artificial
  peptide construct
  MISC_FEATURE (1)..(1): X is D and E for acidic amino acids
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F, W or Y for aromatic amino acids
  MISC_FEATURE (11)..(11): X is D and E for acidic amino acids
  MISC_FEATURE (12)..(12): X is I, L or V
  MISC_FEATURE (13)..(13): X is A and G
  MISC_FEATURE (14)..(14): X is A and G
  MISC_FEATURE (15)..(15): X is A and G
  MISC_FEATURE (16)..(16): X is D and E for acidic amino acids
  MISC_FEATURE (17)..(17): X is I, L or V
  MISC_FEATURE (18)..(18): X is I, L or V
  MISC_FEATURE (19)..(19): X is K, R or H for basic amino acids
  MISC_FEATURE (20)..(20): X is N or Q for amidated amino acids
  MISC_FEATURE (21)..(21): X is A and G
  MISC_FEATURE (22)..(22): X is D and E for acidic amino acids
  MISC_FEATURE (23)..(23): Xis K, R or H for basic amino acids
  MISC_FEATURE (24)..(24): X is I, L or V
  MISC_FEATURE (25)..(25): X is D and E for acidic amino acids
  MISC_FEATURE (26)..(26): X is K, R or H for basic amino acids
  MISC_FEATURE (27)..(27): X is I, L or V
  MISC_FEATURE (28)..(28): X is D and E for acidic amino acids
XXXXXXXXXXXXXXXXXXXXXXXXXXXX

SEQ ID NO: 383 - protein, 26 aa, Artificial
  Completely synthesized peptide construct
DAEFRHDSGYGGGDLLKNGERIEKVE

SEQ ID NO: 384 - protein, 26 aa, Artificial
  peptide construct
  MISC_FEATURE (1)..(1): X is D and E for acidic amino acids
  MISC_FEATURE (2)..(2): X is A or G
  MISC_FEATURE (3)..(3): X is D and E for acidic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is K, R or H for basic amino acids
  MISC_FEATURE (7)..(7): X is D and E for acidic amino acids
  MISC_FEATURE (8)..(8): X is T or S
  MISC_FEATURE (9)..(9): X is A or G
  MISC_FEATURE (10)..(10): X is F,  W or Y for aromatic amino acids
  MISC_FEATURE (11)..(11): X is A and G
  MISC_FEATURE (12)..(12): X is A and G
  MISC_FEATURE (13)..(13): X is A and G
  MISC_FEATURE (14)..(14): X is D and E for acidic amino acids
  MISC_FEATURE (15)..(15): X is I, L or V
  MISC_FEATURE (16)..(16): X is I, L or V
  MISC_FEATURE (17)..(17): X is K, R or H for basic amino acids
  MISC_FEATURE (18)..(18): X is N or Q for amidated amino acids
  MISC_FEATURE (19)..(19): X is A and G
  MISC_FEATURE (20)..(20): X is D and E for acidic amino acids
  MISC_FEATURE (21)..(21): X is K, R or H for basic amino acids
  MISC_FEATURE (22)..(22): X is I, L or V
  MISC_FEATURE (23)..(23): X is D and E for acidic amino acids
  MISC_FEATURE (24)..(24): X is K, R or H for basic amino acids
  MISC_FEATURE (25)..(25): X is I, L or V
  MISC_FEATURE (26)..(26): X is D and E for acidic amino acids
XXXXXXXXXXXXXXXXXXXXXXXXXX

SEQ ID NO: 385 - protein, 20 aa, Artificial
  Completely synthesized peptide construct
EFRHGGGDLLKNGERIEKVE

SEQ ID NO: 386 - protein, 20 aa, Artificial
  peptide construct
  MISC_FEATURE (1)..(1): X is D and E for acidic amino acids
  MISC_FEATURE (2)..(2): X is F or P
  MISC_FEATURE (3)..(3): X is K, R or H for basic amino acids
  MISC_FEATURE (4)..(4): X is K, R or H for basic amino acids
  MISC_FEATURE (5)..(5): X is A and G
  MISC_FEATURE (6)..(6): X is A and G
  MISC_FEATURE (7)..(7): X is A and G
  MISC_FEATURE (8)..(8): X is D and E for acidic amino acids
  MISC_FEATURE (9)..(9): X is I, L or V
  MISC_FEATURE (10)..(10): X is I, L or V
  MISC_FEATURE (11)..(11): X is K, R or H for basic amino acids
  MISC_FEATURE (12)..(12): X is N or Q for amidated amino acids
  MISC_FEATURE (13)..(13): X is A and G
  MISC_FEATURE (14)..(14): X is D and E for acidic amino acids
  MISC_FEATURE (15)..(15): X is K, R or H for basic amino acids
  MISC_FEATURE (16)..(16): X is I, L or V
  MISC_FEATURE (17)..(17): X is D and E for acidic amino acids
  MISC_FEATURE (18)..(18): X is K, R or H for basic amino acids
  MISC_FEATURE (19)..(19): X is I, L or V
  MISC_FEATURE (20)..(20): X is D and E for acidic amino acids
XXXXXXXXXXXXXXXXXXXX

SEQ ID NO: 387 - protein, 35 aa, Artificial
  Completely synthesized peptide construct
DSAFDVLSFTAEEKAGVYKGGGDLLKNGERIEKVE

SEQ ID NO: 388 - protein, 35 aa, Artificial; identical to SEQ ID NO: 197
  peptide construct
  MISC_FEATURE (1)..(1): X is D and E for acidic amino acids
  MISC_FEATURE (2)..(2): X is C or S
  MISC_FEATURE (3)..(3): X is A or G
  MISC_FEATURE (4)..(4): X is F, W or Y for aromatic amino acids
  MISC_FEATURE (5)..(5): X is D and E for acidic amino acids
  MISC_FEATURE (6)..(6): X is I, L or V
  MISC_FEATURE (7)..(7): X is I, L or V
  MISC_FEATURE (8)..(8): X is C or S
  MISC_FEATURE (9)..(9): X is F, W or Y for aromatic amino acids
  MISC_FEATURE (10)..(10): X is T or S
  MISC_FEATURE (11)..(11): X is A or G
  MISC_FEATURE (12)..(12): X is D and E for acidic amino acids
  MISC_FEATURE (13)..(13): X is D and E for acidic amino acids
  MISC_FEATURE (14)..(14): X is K, R or H for basic amino acids
  MISC_FEATURE (15)..(15): X is A or G
  MISC_FEATURE (16)..(16): X is A or G
  MISC_FEATURE (17)..(17): X is I, L or V
  MISC_FEATURE (18)..(18): X is F, W or Y for aromatic amino acids
  MISC_FEATURE (19)..(19): X is K, R or H for basic amino acids
  MISC_FEATURE (20)..(20): X is A and G
  MISC_FEATURE (21)..(21): X is A and G
  MISC_FEATURE (22)..(22): X is A and G
  MISC_FEATURE (23)..(23): X is D and E for acidic amino acids
  MISC_FEATURE (24)..(24): X is I, L or V
  MISC_FEATURE (25)..(25): X is I, L or V
  MISC_FEATURE (26)..(26): X is K, R or H for basic amino acids
  MISC_FEATURE (27)..(27): X is N or Q for amidated amino acids
  MISC_FEATURE (28)..(28): X is A and G
  MISC_FEATURE (29)..(29): X is D and E for acidic amino acids
  MISC_FEATURE (30)..(30): X is K, R or H for basic amino acids
  MISC_FEATURE (31)..(31): X is I, L or V
  MISC_FEATURE (32)..(32): X is D and E for acidic amino acids
  MISC_FEATURE (33)..(33): X is K, R or H for basic amino acids
  MISC_FEATURE (34)..(34): X is I, L or V
  MISC_FEATURE (35)..(35): X is D and E for acidic amino acids

SEQ ID NO: 389 - protein, 30 aa, Artificial
  Completely synthesized peptide construct
SLKLMATLFSTYASGGGDLLKNGERIEKVE

SEQ ID NO: 390 - protein, 30 aa, Artificial; identical to SEQ ID NO: 56
  peptide construct
  MISC_FEATURE (1)..(1): X is C or S
  MISC_FEATURE (2)..(2): X is I, L or V
  MISC_FEATURE (3)..(3): X is K, R or H for basic amino acids
  MISC_FEATURE (4)..(4): X is I, L or V
  MISC_FEATURE (5)..(5): X is M or Nle
  MISC_FEATURE (6)..(6): X is A or G
  MISC_FEATURE (7)..(7): X is T or S
  MISC_FEATURE (8)..(8): X is I, L or V
  MISC_FEATURE (9)..(9): X is F or P
  MISC_FEATURE (10)..(10): X is C or S
  MISC_FEATURE (11)..(11): X is T or S
  MISC_FEATURE (12)..(12): X is F, W or Y for aromatic amino acids
  MISC_FEATURE (13)..(13): X is A or G
  MISC_FEATURE (14)..(14): X is C or S
  MISC_FEATURE (15)..(15): X is A and G
  MISC_FEATURE (16)..(16): X is A and G
  MISC_FEATURE (17)..(17): X is A and G
  MISC_FEATURE (18)..(18): X is D and E for acidic amino acids
  MISC_FEATURE (19)..(19): X is I, L or V
  MISC_FEATURE (20)..(20): X is I, L or V
  MISC_FEATURE (21)..(21): X is K, R or H for basic amino acids
  MISC_FEATURE (22)..(22): X is N or Q for amidated amino acids
  MISC_FEATURE (23)..(23): X is A and G
  MISC_FEATURE (24)..(24): X is D and E for acidic amino acids
  MISC_FEATURE (25)..(25): X is K, R or H for basic amino acids
  MISC_FEATURE (26)..(26): X is I, L or V
  MISC_FEATURE (27)..(27): X is D and E for acidic amino acids
  MISC_FEATURE (28)..(28): X is K, R or H for basic amino acids
  MISC_FEATURE (29)..(29): X is I, L or V
  MISC_FEATURE (30)..(30): X is D and E for acidic amino acids

SEQ ID NO: 391 - protein, 29 aa, Artificial
  Completely synthesized peptide construct
LKLMATLFSSYATGGGDLLKNGERIEKVE

SEQ ID NO: 392 - protein, 30 aa, Artificial; identical to SEQ ID NO: 56
  peptide construct
  MISC_FEATURE (1)..(1): X is C or S
  MISC_FEATURE (2)..(2): X is I, L or V
  MISC_FEATURE (3)..(3): X is K, R or  H for basic amino acids
  MISC_FEATURE (4)..(4): X is I, L or V
  MISC_FEATURE (5)..(5): X is M or Nle
  MISC_FEATURE (6)..(6): X is A or G
  MISC_FEATURE (7)..(7): X is T or S
  MISC_FEATURE (8)..(8): X is I, L or V
  MISC_FEATURE (9)..(9): X is F or P
  MISC_FEATURE (10)..(10): X is C or S
  MISC_FEATURE (11)..(11): X is C or S
  MISC_FEATURE (12)..(12): X is F, W or Y for aromatic amino acids
  MISC_FEATURE (13)..(13): X is A or G
  MISC_FEATURE (14)..(14): X is T or S
  MISC_FEATURE (15)..(15): X is A and G
  MISC_FEATURE (16)..(16): X is A and G
  MISC_FEATURE (17)..(17): X is A and G
  MISC_FEATURE (18)..(18): X is D and E for acidic amino acids
  MISC_FEATURE (19)..(19): X is I, L or V
  MISC_FEATURE (20)..(20): X is I, L or V
  MISC_FEATURE (21)..(21): X is K, R or H for basic amino acids
  MISC_FEATURE (22)..(22): X is N or Q for amidated amino acids
  MISC_FEATURE (23)..(23): X is A and G
  MISC_FEATURE (24)..(24): X is D and E for acidic amino acids
  MISC_FEATURE (25)..(25): X is K, R or H for basic amino acids
  MISC_FEATURE (26)..(26): X is I, L or V
  MISC_FEATURE (27)..(27): X is D and E for acidic amino acids
  MISC_FEATURE (28)..(28): X is K, R or H for basic amino acids
  MISC_FEATURE (29)..(29): X is I, L or V
  MISC_FEATURE (30)..(30): X is D and E for acidic amino acids

SEQ ID NO: 393 - protein, 27 aa, Artificial
  Completely synthesized peptide construct
NITEIADLTQKGGGDLLKNGERIEKVE

SEQ ID NO: 394 - protein, 27 aa, Artificial
  peptide construct
  MISC_FEATURE (1)..(1): X is N or Q for amidated amino acids
  MISC_FEATURE (2)..(2): X is I, L or V
  MISC_FEATURE (3)..(3): X is T or S
  MISC_FEATURE (4)..(4): X is D and E for acidic amino acids
  MISC_FEATURE (5)..(5): X is I, L or V
  MISC_FEATURE (6)..(6): X is A or G
  MISC_FEATURE (7)..(7): X is D and E for acidic amino acids
  MISC_FEATURE (8)..(8): X is I, L or V
  MISC_FEATURE (9)..(9): X is T or S
  MISC_FEATURE (10)..(10): X is N or Q for amidated amino acids
  MISC_FEATURE (11)..(11): X is K, R or H for basic amino acids
  MISC_FEATURE (12)..(12): X is A and G
  MISC_FEATURE (13)..(13): X is A and G
  MISC_FEATURE (14)..(14): X is A and G
  MISC_FEATURE (15)..(15): X is D and E for acidic amino acids
  MISC_FEATURE (16)..(16): X is I, L or V
  MISC_FEATURE (17)..(17): X is I, L or V
  MISC_FEATURE (18)..(18): X is K, R or H for basic amino acids
  MISC_FEATURE (19)..(19): X is N or Q for amidated amino acids
  MISC_FEATURE (20)..(20): X is A and G
  MISC_FEATURE (21)..(21): X is D and E for acidic amino acids
  MISC_FEATURE (22)..(22): X is K, R or H for basic amino acids
  MISC_FEATURE (23)..(23): X is I, L or V
  MISC_FEATURE (24)..(24): X is D and E for acidic amino acids
  MISC_FEATURE (25)..(25): X is K, R or H for basic amino acids
  MISC_FEATURE (26)..(26): X is I, L or V
  MISC_FEATURE (27)..(27): X is D and E for acidic amino acids
XXXXXXXXXXXXXXXXXXXXXXXXXXX

SEQ ID NO: 395 - protein, 56 aa, Artificial [sequence omitted]

SEQ ID NO: 396 - protein, 56 aa, Artificial; identical to SEQ ID NO: 292
  peptide construct
  MISC_FEATURE (1)..(1): X is N or Q for amidated amino acids
  MISC_FEATURE (2)..(2): X is M or Nle
  MISC_FEATURE (3)..(3): X is F, W or Y for aromatic amino acids
  MISC_FEATURE (4)..(4): X is A or G
  MISC_FEATURE (5)..(5): X is M or Nle
  MISC_FEATURE (6)..(6): X is M or Nle
  MISC_FEATURE (7)..(7): X is I, L or V
  MISC_FEATURE (8)..(8): X is A or G
  MISC_FEATURE (9)..(9): X is K, R or H for basic amino acids
  MISC_FEATURE (10)..(10): X is F, W or Y for aromatic amino acids
  MISC_FEATURE (11)..(11): X is K, R or H for basic amino acids
  MISC_FEATURE (12)..(12): X is M or Nle
  MISC_FEATURE (13)..(13): X is F, W or Y for aromatic amino acids
  MISC_FEATURE (14)..(14): X is F or P
  MISC_FEATURE (15)..(15): X is D and E for acidic amino acids
  MISC_FEATURE (16)..(16): X is I, L or V
  MISC_FEATURE (17)..(17): X is K, R or H for basic amino acids
  MISC_FEATURE (18)..(18): X is D and E for acidic amino acids
  MISC_FEATURE (19)..(19): X is K, R or H for basic amino acids
  MISC_FEATURE (20)..(20): X is A or G
  MISC_FEATURE (21)..(21): X is M or Nle
  MISC_FEATURE (22)..(22): X is A or G
  MISC_FEATURE (23)..(23): X is A or G
  MISC_FEATURE (24)..(24): X is I, L or V
  MISC_FEATURE (25)..(25): X is F or P
  MISC_FEATURE (26)..(26): X is K, R or H for basic amino acids
  MISC_FEATURE (27)..(27): X is I, L or V
  MISC_FEATURE (28)..(28): X is I, L or V
  MISC_FEATURE (29)..(29): X is A or G
  MISC_FEATURE (30)..(30): X is F, W or Y for aromatic amino acids
  MISC_FEATURE (31)..(31): X is T or S
  MISC_FEATURE (32)..(32): X is C or S
  MISC_FEATURE (33)..(33): X is D and E for acidic amino acids
  MISC_FEATURE (34)..(34): X is K, R or H for basic amino acids
  MISC_FEATURE (35)..(35): X is C or S
  MISC_FEATURE (36)..(36): X is K, R or H for basic amino acids
  MISC_FEATURE (37)..(37): X is F, W or Y for aromatic amino acids
  MISC_FEATURE (38)..(38): X is C or S
  MISC_FEATURE (39)..(39): X is I, L or V
  MISC_FEATURE (40)..(40): X is K, R or H for basic amino acids
  MISC_FEATURE (41)..(41): X is A and G
  MISC_FEATURE (42)..(42): X is A and G
  MISC_FEATURE (43)..(43): X is A and G
  MISC_FEATURE (44)..(44): X is D and E for acidic amino acids
  MISC_FEATURE (45)..(45): X is I, L or V
  MISC_FEATURE (46)..(46): X is I, L or V
  MISC_FEATURE (47)..(47): X is K, R or H for basic amino acids
  MISC_FEATURE (48)..(48): X is N or Q for amidated amino acids
  MISC_FEATURE (49)..(49): X is A and G
  MISC_FEATURE (50)..(50): X is D and E for acidic amino acids
  MISC_FEATURE (51)..(51): X is K, R or H for basic amino acids
  MISC_FEATURE (52)..(52): X is I, L or V
  MISC_FEATURE (53)..(53): X is D and  E for acidic amino acids
  MISC_FEATURE (54)..(54): X is K, R or H for basic amino acids
  MISC_FEATURE (55)..(55): X is I, L or V
  MISC_FEATURE (56)..(56): X is D and E for acidic amino acids

SEQ ID NO: 397 - protein, 50 aa, Artificial
  Completely synthesized peptide construct
IARFKMFPEVKEKGMAALPRLIAFTSEHSHFSLKGGGDLLKNGERIEKVE

SEQ ID NO: 398 - protein, 50 aa, Artificial; identical to SEQ ID NO: 318
  peptide construct
  MISC_FEATURE (1)..(1): X is I,  L or V
  MISC_FEATURE (2)..(2): X is A or G
  MISC_FEATURE (3)..(3): X is K, R or H for basic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is M or Nle
  MISC_FEATURE (7)..(7): X is F, W or Y for aromatic amino acids
  MISC_FEATURE (8)..(8): X is F or P
  MISC_FEATURE (9)..(9): X is D and E for acidic amino acids
  MISC_FEATURE (10)..(10): X is I, L or V
  MISC_FEATURE (11)..(11): X is K, R or H for basic amino acids
  MISC_FEATURE (12)..(12): X is D and E for acidic amino acids
  MISC_FEATURE (13)..(13): X is K, R or H for basic amino acids
  MISC_FEATURE (14)..(14): X is A or G
  MISC_FEATURE (15)..(15): X is M or Nle
  MISC_FEATURE (16)..(16): X is A or G
  MISC_FEATURE (17)..(17): X is A or G
  MISC_FEATURE (18)..(18): X is I, L or V
  MISC_FEATURE (19)..(19): X is F or P
  MISC_FEATURE (20)..(20): X is K, R or H for basic amino acids
  MISC_FEATURE (21)..(21): X is I, L or V
  MISC_FEATURE (22)..(22): X is I, L or V
  MISC_FEATURE (23)..(23): X is A or G
  MISC_FEATURE (24)..(24): X is F, W or Y for aromatic amino acids
  MISC_FEATURE (25)..(25): X is T or S
  MISC_FEATURE (26)..(26): X is C or S
  MISC_FEATURE (27)..(27): X is D and E for acidic amino acids
  MISC_FEATURE (28)..(28): X is K, R or H for basic amino acids
  MISC_FEATURE (29)..(29): X is C or S
  MISC_FEATURE (30)..(30): X is K, R or H for basic amino acids
  MISC_FEATURE (31)..(31): X is F, W or Y for aromatic amino acids
  MISC_FEATURE (32)..(32): X is C or S
  MISC_FEATURE (33)..(33): X is I, L or V
  MISC_FEATURE (34)..(34): X is K, R or H for basic amino acids
  MISC_FEATURE (35)..(35): X is A and G
  MISC_FEATURE (36)..(36): X is A and G
  MISC_FEATURE (37)..(37): X is A and G
  MISC_FEATURE (38)..(38): X is D and E for acidic amino acids
  MISC_FEATURE (39)..(39): X is I, L or V
  MISC_FEATURE (40)..(40): X is I, L or V
  MISC_FEATURE (41)..(41): X is K, R or H for basic amino acids
  MISC_FEATURE (42)..(42): X is N or Q for amidated amino acids
  MISC_FEATURE (43)..(43): X is A and G
  MISC_FEATURE (44)..(44): X is D and E for acidic amino acids
  MISC_FEATURE (45)..(45): X is K, R or H for basic amino acids
  MISC_FEATURE (46)..(46): X is I, L or V
  MISC_FEATURE (47)..(47): X is D and E for acidic amino acids
  MISC_FEATURE (48)..(48): X is K, R or H for basic amino acids
  MISC_FEATURE (49)..(49): X is I, L or V
  MISC_FEATURE (50)..(50): X is D and E for acidic amino acids

SEQ ID NO: 399 - protein, 36 aa, Artificial
  Completely synthesized peptide construct
SRLSKVAPVIKARMMEYGTTGGGDLLKNGERIEKVE

SEQ ID NO: 400 - protein, 36 aa, Artificial; identical to SEQ ID NO: 164
  peptide construct
  MISC_FEATURE (1)..(1): X is C or S
  MISC_FEATURE (2)..(2): X is K, R or H for basic amino acids
  MISC_FEATURE (3)..(3): X is I, L or V
  MISC_FEATURE (4)..(4): X is C or S
  MISC_FEATURE (5)..(5): X is K, R or H for basic amino acids
  MISC_FEATURE (6)..(6): X is I, L or V
  MISC_FEATURE (7)..(7): X is A or G
  MISC_FEATURE (8)..(8): X is F or P
  MISC_FEATURE (9)..(9): X is I, L or V
  MISC_FEATURE (10)..(10): X is I, L or V
  MISC_FEATURE (11)..(11): X is K, R or H for basic amino acids
  MISC_FEATURE (12)..(12): X is A or G
  MISC_FEATURE (13)..(13): X is K, R or H for basic amino acids
  MISC_FEATURE (14)..(14): X is M or Nle
  MISC_FEATURE (15)..(15): X is M or Nle
  MISC_FEATURE (16)..(16): X is D and E for acidic amino acids
  MISC_FEATURE (17)..(17): X is F, W or Y for aromatic amino acids
  MISC_FEATURE (18)..(18): X is A or G
  MISC_FEATURE (19)..(19): X is T or S
  MISC_FEATURE (20)..(20): X is T or S
  MISC_FEATURE (21)..(21): X is A and G
  MISC_FEATURE (22)..(22): X is A and G
  MISC_FEATURE (23)..(23): X is A and G
  MISC_FEATURE (24)..(24): X is D and E for acidic amino acids
  MISC_FEATURE (25)..(25): X is I, L or V
  MISC_FEATURE (26)..(26): X is I, L or V
  MISC_FEATURE (27)..(27): X is K, R or H for basic amino acids
  MISC_FEATURE (28)..(28): X is N or Q for amidated amino acids
  MISC_FEATURE (29)..(29): X is A and G
  MISC_FEATURE (30)..(30): X is D and E for acidic amino acids
  MISC_FEATURE (31)..(31): X is K, R or H for basic amino acids
  MISC_FEATURE (32)..(32): X is I, L or V
  MISC_FEATURE (33)..(33): X is D and E for acidic amino acids
  MISC_FEATURE (34)..(34): X is K, R or H for basic amino acids
  MISC_FEATURE (35)..(35): X is I, L or V
  MISC_FEATURE (36)..(36): X is D and E for acidic amino acids

SEQ ID NO: 401 - protein, 35 aa, Artificial
  Completely synthesized peptide construct
IPPSLRYLEDEERMSRLSKGGGDLLKNGERIEKVE

SEQ ID NO: 402 - protein, 34 aa, Artificial; identical to SEQ ID NO: 77
  peptide construct
  MISC_FEATURE (1)..(1): X is I, L or V
  MISC_FEATURE (2)..(2): X is F or P
  MISC_FEATURE (3)..(3): X is F or P
  MISC_FEATURE (4)..(4): X is C or S
  MISC_FEATURE (5)..(5): X is I, L or V
  MISC_FEATURE (6)..(6): X is K, R or H for basic amino acids
  MISC_FEATURE (7)..(7): X is F, W or Y for aromatic amino acids
  MISC_FEATURE (8)..(8): X is D and E for acidic amino acids
  MISC_FEATURE (9)..(9): X is D and E for acidic amino acids
  MISC_FEATURE (10)..(10): X is D and E for acidic amino acids
  MISC_FEATURE (11)..(11): X is D and E for acidic amino acids
  MISC_FEATURE (12)..(12): X is K, R or H for basic amino acids
  MISC_FEATURE (13)..(13): X is M or Nle
  MISC_FEATURE (14)..(14): X is C or S
  MISC_FEATURE (15)..(15): X is K, R or H for basic amino acids
  MISC_FEATURE (16)..(16): X is I, L or V
  MISC_FEATURE (17)..(17): X is C or S
  MISC_FEATURE (18)..(18): X is K, R or H for basic amino acids
  MISC_FEATURE (19)..(19): X is A and G
  MISC_FEATURE (20)..(20): X is A and G
  MISC_FEATURE (21)..(21): X is A and G
  MISC_FEATURE (22)..(22): X is D and E for acidic amino acids
  MISC_FEATURE (23)..(23): X is I, L or V
  MISC_FEATURE (24)..(24): X is I, L or V
  MISC_FEATURE (25)..(25): X is K, R or H for basic amino acids
  MISC_FEATURE (26)..(26): X is N or Q for amidated amino acids
  MISC_FEATURE (27)..(27): X is A and G
  MISC_FEATURE (28)..(28): X is D and E for acidic amino acids
  MISC_FEATURE (29)..(29): X is K, R or H for basic amino acids
  MISC_FEATURE (30)..(30): X is I, L or V
  MISC_FEATURE (31)..(31): X is D and E for acidic amino acids
  MISC_FEATURE (32)..(32): X is K, R or H for basic amino acids
  MISC_FEATURE (33)..(33): X is I, L or V
  MISC_FEATURE (34)..(34): X is D and E for acidic amino acids

SEQ ID NO: 403 - protein, 36 aa, Artificial
  Completely synthesized peptide construct
NTNMFTYEIAPVFVLLEYVTGGGDLLKNGERIEKVE

SEQ ID NO: 404 - protein, 36 aa, Artificial; identical to SEQ ID NO: 164
  peptide construct
  MISC_FEATURE (1)..(1): X is N or Q for aromatic amino acids
  MISC_FEATURE (2)..(2): X is T or S
  MISC_FEATURE (3)..(3): X is N or Q for aromatic amino acids
  MISC_FEATURE (4)..(4): X is M or Nle
  MISC_FEATURE (5)..(5): X is F, W or Y for aromatic amino acids
  MISC_FEATURE (6)..(6): X is T or S
  MISC_FEATURE (7)..(7): X is F, W or  Y for aromatic amino acids
  MISC_FEATURE (8)..(8): X is D and E for acidic amino acids
  MISC_FEATURE (9)..(9): X is I, L or V
  MISC_FEATURE (10)..(10): X is A or G
  MISC_FEATURE (11)..(11): X is F or P
  MISC_FEATURE (12)..(12): X is I, L or V
  MISC_FEATURE (13)..(13): X is F, W or Y for aromatic amino acids
  MISC_FEATURE (14)..(14): X is I, L or V
  MISC_FEATURE (15)..(15): X is I, L or V
  MISC_FEATURE (16)..(16): X is I, L or V
  MISC_FEATURE (17)..(17): X is D and E for acidic amino acids
  MISC_FEATURE (18)..(18): X is F, W or Y for aromatic amino acids
  MISC_FEATURE (19)..(19): X is I, L or V
  MISC_FEATURE (20)..(20): X is T or S
  MISC_FEATURE (21)..(21): X is A and G
  MISC_FEATURE (22)..(22): X is A and G
  MISC_FEATURE (23)..(23): X is A and G
  MISC_FEATURE (24)..(24): X is D and E for acidic amino acids
  MISC_FEATURE (25)..(25): X is I, L or V
  MISC_FEATURE (26)..(26): X is I, L or V
  MISC_FEATURE (27)..(27): X is K, R or H for basic amino acids
  MISC_FEATURE (28)..(28): X is N or Q for amidated amino acids
  MISC_FEATURE (29)..(29): X is A and G
  MISC_FEATURE (30)..(30): X is D and E for acidic amino acids
  MISC_FEATURE (31)..(31): X is K, R or H for basic amino acids
  MISC_FEATURE (32)..(32): X is I, L or V
  MISC_FEATURE (33)..(33): X is D and E for acidic amino acids
  MISC_FEATURE (34)..(34): X is K, R or H for basic amino acids
  MISC_FEATURE (35)..(35): X is I, L or V
  MISC_FEATURE (36)..(36): X is D and E for acidic amino acids

SEQ ID NO: 405 - protein, 31 aa, Artificial
  Completely synthesized peptide construct
FKADEKKFWGKYLYEGGGDLLKNGERIEKVE

SEQ ID NO: 406 - protein, 31 aa, Artificial; identical to SEQ ID NO: 123
  peptide construct
  MISC_FEATURE (1)..(1): X is F, W or  Y for aromatic amino acids
  MISC_FEATURE (2)..(2): X is K, R or H for basic amino acids
  MISC_FEATURE (3)..(3): X is A or G
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is K, R or H for basic amino acids
  MISC_FEATURE (8)..(8): X is F, W or Y for aromatic amino acids
  MISC_FEATURE (9)..(9): X is F, W or Y for aromatic amino acids
  MISC_FEATURE (10)..(10): X is A or G
  MISC_FEATURE (11)..(11): X is K, R or H for basic amino acids
  MISC_FEATURE (12)..(12): X is F, W or Y for aromatic amino acids
  MISC_FEATURE (13)..(13): X is I, L or V
  MISC_FEATURE (14)..(14): X is F, W or Y for aromatic amino acids
  MISC_FEATURE (15)..(15): X is D and E for acidic amino acids
  MISC_FEATURE (16)..(16): X is A and G
  MISC_FEATURE (17)..(17): X is A and G
  MISC_FEATURE (18)..(18): X is A and G
  MISC_FEATURE (19)..(19): X is D and E for acidic amino acids
  MISC_FEATURE (20)..(20): X is I, L or V
  MISC_FEATURE (21)..(21): X is I, L or V
  MISC_FEATURE (22)..(22): X is K, R or H for basic amino acids
  MISC_FEATURE (23)..(23): X is N or Q for amidated amino acids
  MISC_FEATURE (24)..(24): X is A and G
  MISC_FEATURE (25)..(25): X is D and E for acidic amino acids
  MISC_FEATURE (26)..(26): X is K, R or H for basic amino acids
  MISC_FEATURE (27)..(27): X is I, L or V
  MISC_FEATURE (28)..(28): X is D and E for acidic amino acids
  MISC_FEATURE (29)..(29): X is K, R or H for basic amino acids
  MISC_FEATURE (30)..(30): X is I, L or V
  MISC_FEATURE (31)..(31): X is D and E for acidic amino acids

SEQ ID NO: 407 - protein, 31 aa, Artificial
  Completely synthesized peptide construct
SHLVEALYLVCGERGGGGDLLKNGERIEKVE

SEQ ID NO: 408 - protein, 30 aa, Artificial; identical to SEQ ID NO: 56
  peptide construct
  MISC_FEATURE (1)..(1): X is C or S
  MISC_FEATURE (2)..(2): X is K, R or H for basic amino acids
  MISC_FEATURE (3)..(3): X is I, L or V
  MISC_FEATURE (4)..(4): X is I, L or V
  MISC_FEATURE (5)..(5): X is D and  E for acidic amino acids
  MISC_FEATURE (6)..(6): X is A or G
  MISC_FEATURE (7)..(7): X is I, L or V
  MISC_FEATURE (8)..(8): X is F, W or Y for aromatic amino acids
  MISC_FEATURE (9)..(9): X is I, L or V
  MISC_FEATURE (10)..(10): X is C or S
  MISC_FEATURE (11)..(11): X is A or G
  MISC_FEATURE (12)..(12): X is D and E for acidic amino acids
  MISC_FEATURE (13)..(13): X is K, R or H for basic amino acids
  MISC_FEATURE (14)..(14): X is A or G
  MISC_FEATURE (15)..(15): X is A and G
  MISC_FEATURE (16)..(16): X is A and G
  MISC_FEATURE (17)..(17): X is A and G
  MISC_FEATURE (18)..(18): X is D and E for acidic amino acids
  MISC_FEATURE (19)..(19): X is I, L or V
  MISC_FEATURE (20)..(20): X is I, L or V
  MISC_FEATURE (21)..(21): X is K, R or H for basic amino acids
  MISC_FEATURE (22)..(22): X is N or Q for amidated amino acids
  MISC_FEATURE (23)..(23): X is A and G
  MISC_FEATURE (24)..(24): X is D and E for acidic amino acids
  MISC_FEATURE (25)..(25): X is K, R or H for basic amino acids
  MISC_FEATURE (26)..(26): X is I, L or V
  MISC_FEATURE (27)..(27): X is D and E for acidic amino acids
  MISC_FEATURE (28)..(28): X is K, R or H for basic amino acids
  MISC_FEATURE (29)..(29): X is I, L or V
  MISC_FEATURE (30)..(30): X is D and E for acidic amino acids

SEQ ID NO: 409 - protein, 40 aa, Artificial
  Completely synthesized peptide construct
VLGGGCALLRCIPALDSLTPANEDGGGDLLKNGERIEKVE

SEQ ID NO: 410 - protein, 40 aa, Artificial; identical to SEQ ID NO: 52
  peptide construct
  MISC_FEATURE (1)..(1): X is I, L or V
  MISC_FEATURE (2)..(2): X is I, L or V
  MISC_FEATURE (3)..(3): X is A or G
  MISC_FEATURE (4)..(4): X is A or G
  MISC_FEATURE (5)..(5): X is A or G
  MISC_FEATURE (6)..(6): X is C or S
  MISC_FEATURE (7)..(7): X is A or G
  MISC_FEATURE (8)..(8): X is I, L or V
  MISC_FEATURE (9)..(9): X is I, L or V
  MISC_FEATURE (10)..(10): X is K, R or H for basic amino acids
  MISC_FEATURE (11)..(11): X is C or S
  MISC_FEATURE (12)..(12): X is I, L or V
  MISC_FEATURE (13)..(13): X is F or P
  MISC_FEATURE (14)..(14): X is A or G
  MISC_FEATURE (15)..(15): X is I, L or V
  MISC_FEATURE (16)..(16): X is D and E for acidic amino acids
  MISC_FEATURE (17)..(17): X is C or S
  MISC_FEATURE (18)..(18): X is I, L or V
  MISC_FEATURE (19)..(19): X is T or S
  MISC_FEATURE (20)..(20): X is F or P
  MISC_FEATURE (21)..(21): X is A or G
  MISC_FEATURE (22)..(22): X is N or Q for amidated amino acids
  MISC_FEATURE (23)..(23): X is D and E for acidic amino acids
  MISC_FEATURE (24)..(24): X is D and E for acidic amino acids
  MISC_FEATURE (25)..(25): X is A and G
  MISC_FEATURE (26)..(26): X is A and G
  MISC_FEATURE (27)..(27): X is A and G
  MISC_FEATURE (28)..(28): X is D and E for acidic amino acids
  MISC_FEATURE (29)..(29): X is I, L or V
  MISC_FEATURE (30)..(30): X is I, L or V
  MISC_FEATURE (31)..(31): X is K, R or H for basic amino acids
  MISC_FEATURE (32)..(32): X is N or Q for amidated amino acids
  MISC_FEATURE (33)..(33): X is A and G
  MISC_FEATURE (34)..(34): X is D and E for acidic amino acids
  MISC_FEATURE (35)..(35): X is K, R or H for basic amino acids
  MISC_FEATURE (36)..(36): X is I, L or V
  MISC_FEATURE (37)..(37): X is D and E for acidic amino acids
  MISC_FEATURE (38)..(38): X is K, R or H for basic amino acids
  MISC_FEATURE (39)..(39): X is I, L or V
  MISC_FEATURE (40)..(40): X is D and E for acidic amino acids

SEQ ID NO: 411 - protein, 44 aa, Artificial
  Completely synthesized peptide construct
EACVTSWLWSGEGAVFYRVDLHFINLGTGGGDLLKNGERIEKVE

SEQ ID NO: 412 - protein, 44 aa, Artificial; identical to SEQ ID NO: 294
  peptide construct
  MISC_FEATURE (1)..(1): X is D and E for acidic amino acids
  MISC_FEATURE (2)..(2): X is A or G
  MISC_FEATURE (3)..(3): X is C or S
  MISC_FEATURE (4)..(4): X is I, L or V
  MISC_FEATURE (5)..(5): X is T or S
  MISC_FEATURE (6)..(6): X is C or S
  MISC_FEATURE (7)..(7): X is F, W or Y for aromatic amino acids
  MISC_FEATURE (8)..(8): X is I, L or V
  MISC_FEATURE (9)..(9): X is F, W or Y for aromatic amino acids
  MISC_FEATURE (10)..(10): X is C or S
  MISC_FEATURE (11)..(11): X is A or G
  MISC_FEATURE (12)..(12): X is D and E for acidic amino acids
  MISC_FEATURE (13)..(13): X is A or G
  MISC_FEATURE (14)..(14): X is A or G
  MISC_FEATURE (15)..(15): X is I, L or V
  MISC_FEATURE (16)..(16): X is F, W or Y for aromatic amino acids
  MISC_FEATURE (17)..(17): X is F, W or Y for aromatic amino acids
  MISC_FEATURE (18)..(18): X is K, R or H for basic amino acids
  MISC_FEATURE (19)..(19): X is I, L or V
  MISC_FEATURE (20)..(20): X is D and E for acidic amino acids
  MISC_FEATURE (21)..(21): X is I, L or V
  MISC_FEATURE (22)..(22): X is K, R or H for basic amino acids
  MISC_FEATURE (23)..(23): X is F, W or Y for aromatic amino acids
  MISC_FEATURE (24)..(24): X is I, L or V
  MISC_FEATURE (25)..(25): X is N or Q for amidated amino acids
  MISC_FEATURE (26)..(26): X is I, L or V
  MISC_FEATURE (27)..(27): X is A or G
  MISC_FEATURE (28)..(28): X is T or S
  MISC_FEATURE (29)..(29): X is A and G
  MISC_FEATURE (30)..(30): X is A and G
  MISC_FEATURE (31)..(31): X is A and G
  MISC_FEATURE (32)..(32): X is D and E for acidic amino acids
  MISC_FEATURE (33)..(33): X is I, L or V
  MISC_FEATURE (34)..(34): X is I, L or V
  MISC_FEATURE (35)..(35): X is K, R or H for basic amino acids
  MISC_FEATURE (36)..(36): X is N or Q for amidated amino acids
  MISC_FEATURE (37)..(37): X is A and G
  MISC_FEATURE (38)..(38): X is D and  E for acidic amino acids
  MISC_FEATURE (39)..(39): X is K, R or H for basic amino acids
  MISC_FEATURE (40)..(40): X is I, L or V
  MISC_FEATURE (41)..(41): X is D and E for acidic amino acids
  MISC_FEATURE (42)..(42): X is K, R or H for basic amino acids
  MISC_FEATURE (43)..(43): X is I, L or V
  MISC_FEATURE (44)..(44): X is D and E for acidic amino acids

SEQ ID NO: 413 - protein, 37 aa, Artificial
  Completely synthesized peptide construct
MDFWCVEHDRPPPATPTSLTTGGGDLLKNGERIEKVE

SEQ ID NO: 414 - protein, 37 aa, Artificial; identical to SEQ ID NO: 151
  peptide construct
  MISC_FEATURE (1)..(1): X is M or Nle
  MISC_FEATURE (2)..(2): X is D and E for acidic amino acids
  MISC_FEATURE (3)..(3): X is F, W or Y for aromatic amino acids
  MISC_FEATURE (4)..(4): X is F, W or Y for aromatic amino acids
  MISC_FEATURE (5)..(5): X is C or S
  MISC_FEATURE (6)..(6): X is I, L or V
  MISC_FEATURE (7)..(7): X is D and E for acidic amino acids
  MISC_FEATURE (8)..(8): X is K, R or H for basic amino acids
  MISC_FEATURE (9)..(9): X is D and E for acidic amino acids
  MISC_FEATURE (10)..(10): X is K, R or H for basic amino acids
  MISC_FEATURE (11)..(11): X is F or P
  MISC_FEATURE (12)..(12): X is F or P
  MISC_FEATURE (13)..(13): X is F or P
  MISC_FEATURE (14)..(14): X is A or G
  MISC_FEATURE (15)..(15): X is T or S
  MISC_FEATURE (16)..(16): X is F or P
  MISC_FEATURE (17)..(17): X is T or S
  MISC_FEATURE (18)..(18): X is C or S
  MISC_FEATURE (19)..(19): X is I, L or V
  MISC_FEATURE (20)..(20): X is T or S
  MISC_FEATURE (21)..(21): X is T or S
  MISC_FEATURE (22)..(22): X is A and G
  MISC_FEATURE (23)..(23): X is A and G
  MISC_FEATURE (24)..(24): X is A and G
  MISC_FEATURE (25)..(25): X is D and E for acidic amino acids
  MISC_FEATURE (26)..(26): X is I, L or V
  MISC_FEATURE (27)..(27): X is I, L or V
  MISC_FEATURE (28)..(28): X is K, R or H for basic amino acids
  MISC_FEATURE (29)..(29): X is  N or Q for amidated amino acids
  MISC_FEATURE (30)..(30): X is A and G
  MISC_FEATURE (31)..(31): X is D and E for acidic amino acids
  MISC_FEATURE (32)..(32): X is K, R or H for basic amino acids
  MISC_FEATURE (33)..(33): X is I, L or V
  MISC_FEATURE (34)..(34): X is D and E for acidic amino acids
  MISC_FEATURE (35)..(35): X is K, R or H for basic amino acids
  MISC_FEATURE (36)..(36): X is I, L or V
  MISC_FEATURE (37)..(37): X is D and E for acidic amino acids

SEQ ID NO: 415 - protein, 36 aa, Artificial
  Completely synthesized peptide construct
NMYAMMIARFKMFPEVKEKGGGGDLLKNGERIEKVE

SEQ ID NO: 416 - protein, 36 aa, Artificial; identical to SEQ ID NO: 164
  peptide construct
  MISC_FEATURE (1)..(1): X is N or Q for amidated amino acids
  MISC_FEATURE (2)..(2): X is M or Nle
  MISC_FEATURE (3)..(3): X is F, W or Y for aromatic amino acids
  MISC_FEATURE (4)..(4): X is A or G
  MISC_FEATURE (5)..(5): X is M or Nle
  MISC_FEATURE (6)..(6): X is M or Nle
  MISC_FEATURE (7)..(7): X is I, L or V
  MISC_FEATURE (8)..(8): X is A or G
  MISC_FEATURE (9)..(9): X is K, R or H for basic amino acids
  MISC_FEATURE (10)..(10): X is F, W or Y for aromatic amino acids
  MISC_FEATURE (11)..(11): X is K,  R or H for basic amino acids
  MISC_FEATURE (12)..(12): X is M or Nle
  MISC_FEATURE (13)..(13): X is F, W or Y for aromatic amino acids
  MISC_FEATURE (14)..(14): X is F or P
  MISC_FEATURE (15)..(15): X is D and E for acidic amino acids
  MISC_FEATURE (16)..(16): X is I, L or V
  MISC_FEATURE (17)..(17): X is K, R or H for basic amino acids
  MISC_FEATURE (18)..(18): X is D and E for acidic amino acids
  MISC_FEATURE (19)..(19): X is K, R or H for basic amino acids
  MISC_FEATURE (20)..(20): X is A or G
  MISC_FEATURE (21)..(21): X is A and G
  MISC_FEATURE (22)..(22): X is A and G
  MISC_FEATURE (23)..(23): X is A and G
  MISC_FEATURE (24)..(24): X is D and E for acidic amino acids
  MISC_FEATURE (25)..(25): X is I, L or V
  MISC_FEATURE (26)..(26): X is I, L or V
  MISC_FEATURE (27)..(27): X is K, R or H for basic amino acids
  MISC_FEATURE (28)..(28): X is N or Q for amidated amino acids
  MISC_FEATURE (29)..(29): X is A and G
  MISC_FEATURE (30)..(30): X is D and E for acidic amino acids
  MISC_FEATURE (31)..(31): X is K, R or H for basic amino acids
  MISC_FEATURE (32)..(32): X is I, L or V
  MISC_FEATURE (33)..(33): X is D and E for acidic amino acids
  MISC_FEATURE (34)..(34): X is K, R or H for basic amino acids
  MISC_FEATURE (35)..(35): X is D and E for acidic amino acids
  MISC_FEATURE (36)..(36): X is I, L or V

SEQ ID NO: 417 - protein, 49 aa, Artificial
  Completely synthesized peptide construct
NMYAMMIARFKMFPEVKEKGMAALPRLIAFTSEGGGDLLKNGERIEKVE

SEQ ID NO: 418 - protein, 49 aa, Artificial; identical to SEQ ID NO: 338
  peptide construct
  MISC_FEATURE (1)..(1): X is N or Q for amidated amino acids
  MISC_FEATURE (2)..(2): X is M or Nle
  MISC_FEATURE (3)..(3): X is F, W or Y for aromatic amino acids
  MISC_FEATURE (4)..(4): X is A or G
  MISC_FEATURE (5)..(5): X is M or Nle
  MISC_FEATURE (6)..(6): X is M or Nle
  MISC_FEATURE (7)..(7): X is I, L or V
  MISC_FEATURE (8)..(8): X is A or G
  MISC_FEATURE (9)..(9): X is K, R or H for basic amino acids
  MISC_FEATURE (10)..(10): X is F, W or Y for aromatic amino acids
  MISC_FEATURE (11)..(11): X is K, R or H for basic amino acids
  MISC_FEATURE (12)..(12): X is M or Nle
  MISC_FEATURE (13)..(13): X is F, W or Y for aromatic amino acids
  MISC_FEATURE (14)..(14): X is F or P
  MISC_FEATURE (15)..(15): X is D and E for acidic amino acids
  MISC_FEATURE (16)..(16): X is I, L or V
  MISC_FEATURE (17)..(17): X is K, R or H for basic amino acids
  MISC_FEATURE (18)..(18): X is D and E for acidic amino acids
  MISC_FEATURE (19)..(19): X is K, R or H for basic amino acids
  MISC_FEATURE (20)..(20): X is A or G
  MISC_FEATURE (21)..(21): X is M or Nle
  MISC_FEATURE (22)..(22): X is A or G
  MISC_FEATURE (23)..(23): X is A or G
  MISC_FEATURE (24)..(24): X is I, L or V
  MISC_FEATURE (25)..(25): X is F or P
  MISC_FEATURE (26)..(26): X is K, R or H for basic amino acids
  MISC_FEATURE (27)..(27): X is I, L or V
  MISC_FEATURE (28)..(28): X is I, L or V
  MISC_FEATURE (29)..(29): X is A or G
  MISC_FEATURE (30)..(30): X is F, W or Y for aromatic amino acids
  MISC_FEATURE (31)..(31): X is T or S
  MISC_FEATURE (32)..(32): X is C or S
  MISC_FEATURE (33)..(33): X is D and E for acidic amino acids
  MISC_FEATURE (34)..(34): X is A and G
  MISC_FEATURE (35)..(35): X is A and G
  MISC_FEATURE (36)..(36): X is A and G
  MISC_FEATURE (37)..(37): X is D and E for acidic amino acids
  MISC_FEATURE (38)..(38): X is I, L or V
  MISC_FEATURE (39)..(39): X is I, L or V
  MISC_FEATURE (40)..(40): X is K, R or H for basic amino acids
  MISC_FEATURE (41)..(41): X is N or Q for amidated amino acids
  MISC_FEATURE (42)..(42): X is A and G
  MISC_FEATURE (43)..(43): X is D and E for acidic amino acids
  MISC_FEATURE (44)..(44): X is K, R or H for basic amino acids
  MISC_FEATURE (45)..(45): X is I, L or V
  MISC_FEATURE (46)..(46): X is D and E for acidic amino acids
  MISC_FEATURE (47)..(47): X is K, R or H for basic amino acids
  MISC_FEATURE (48)..(48): X is I, L or V
  MISC_FEATURE (49)..(49): X is D and E for acidic amino acids

SEQ ID NO: 419 - protein, 29 aa, Artificial
  Completely synthesized peptide construct
IAFTSEHSHFSLKGGGDLLKNGERIEKVE

SEQ ID NO: 420 - protein, 29 aa, Artificial
  peptide construct
  MISC_FEATURE (1)..(1): X is I, L or V
  MISC_FEATURE (2)..(2): X is A or G
  MISC_FEATURE (3)..(3): X is F, W or Y for aromatic amino acids
  MISC_FEATURE (4)..(4): X is T or S
  MISC_FEATURE (5)..(5): X is C or S
  MISC_FEATURE (6)..(6): X is D and E for acidic amino acids
  MISC_FEATURE (7)..(7): X is K, R or H for basic amino acids
  MISC_FEATURE (8)..(8): X is C or S
  MISC_FEATURE (9)..(9): X is K, R or H for basic amino acids
  MISC_FEATURE (10)..(10): X is F, W or Y for aromatic amino acids
  MISC_FEATURE (11)..(11): X is C or S
  MISC_FEATURE (12)..(12): X is I, L or V
  MISC_FEATURE (13)..(13): X is K, R or H for basic amino acids
  MISC_FEATURE (14)..(14): X is A and G
  MISC_FEATURE (15)..(15): X is A and G
  MISC_FEATURE (16)..(16): X is A and G
  MISC_FEATURE (17)..(17): X is D and E for acidic amino acids
  MISC_FEATURE (18)..(18): X is I, L or V
  MISC_FEATURE (19)..(19): X is I, L or V
  MISC_FEATURE (20)..(20): X is K, R or H for basic amino acids
  MISC_FEATURE (21)..(21): X is N or Q for amidated amino acids
  MISC_FEATURE (22)..(22): X is A and G
  MISC_FEATURE (23)..(23): X is D and E for acidic amino acids
  MISC_FEATURE (24)..(24): X is K, R or H for basic amino acids
  MISC_FEATURE (25)..(25): X is I, L or V
  MISC_FEATURE (26)..(26): X is D and E for acidic amino acids
  MISC_FEATURE (27)..(27): X is K, R or H for basic amino acids
  MISC_FEATURE (28)..(28): X is I, L or V
  MISC_FEATURE (29)..(29): X is D and E for acidic amino acids
XXXXXXXXXXXXXXXXXXXXXXXXXXXXX

SEQ ID NO: 421 - protein, 37 aa, Artificial; identical to SEQ ID NO: 151
  peptide construct
  MISC_FEATURE (1)..(1): X is M or Nle
  MISC_FEATURE (2)..(2): X is D and E for acidic amino acids
  MISC_FEATURE (3)..(3): X is F, W or Y for aromatic amino acids
  MISC_FEATURE (4)..(4): X is F, W or Y for aromatic amino acids
  MISC_FEATURE (5)..(5): X is C or S
  MISC_FEATURE (6)..(6): X is I, L or V
  MISC_FEATURE (7)..(7): X is D and E for acidic amino acids
  MISC_FEATURE (8)..(8): X is K, R or H for basic amino acids
  MISC_FEATURE (9)..(9): X is D and E for acidic amino acids
  MISC_FEATURE (10)..(10): X is K, R or H for basic amino acids
  MISC_FEATURE (11)..(11): X is F or P
  MISC_FEATURE (12)..(12): X is F or P
  MISC_FEATURE (13)..(13): X is F or P
  MISC_FEATURE (14)..(14): X is A or G
  MISC_FEATURE (15)..(15): X is T or S
  MISC_FEATURE (16)..(16): X is F or P
  MISC_FEATURE (17)..(17): X is T or S
  MISC_FEATURE (18)..(18): X is C or S
  MISC_FEATURE (19)..(19): X is I, L or V
  MISC_FEATURE (20)..(20): X is T or S
  MISC_FEATURE (21)..(21): X is T or S
  MISC_FEATURE (22)..(22): X  is A and G
  MISC_FEATURE (23)..(23): X is A and G
  MISC_FEATURE (24)..(24): X is A and G
  MISC_FEATURE (25)..(25): X is D and E for acidic amino acids
  MISC_FEATURE (26)..(26): X is I, L or V
  MISC_FEATURE (27)..(27): X is  I, L or V
  MISC_FEATURE (28)..(28): X is K, R or H for basic amino acids
  MISC_FEATURE (29)..(29): X is N or Q for amidated amino acids
  MISC_FEATURE (30)..(30): X is A and G
  MISC_FEATURE (31)..(31): X is D and E for acidic amino acids
  MISC_FEATURE (32)..(32): X is K, R or H for basic amino acids
  MISC_FEATURE (33)..(33): X is I, L or V
  MISC_FEATURE (34)..(34): X is D and E for acidic amino acids
  MISC_FEATURE (35)..(35): X is K, R or H for basic amino acids
  MISC_FEATURE (36)..(36): X is I, L or V
  MISC_FEATURE (37)..(37): X is D and E for acidic amino acids

SEQ ID NO: 422 - protein, 26 aa, Artificial
  Completely synthesized peptide construct
ERPTLAFLQDGGGDLLKNGERIEKVE

SEQ ID NO: 423 - protein, 26 aa, Artificial
  peptide construct
  MISC_FEATURE (1)..(1): X is D and E for acidic amino acids
  MISC_FEATURE (2)..(2): X is K, R or H for basic amino acids
  MISC_FEATURE (3)..(3): X is F or P
  MISC_FEATURE (4)..(4): X is T or S
  MISC_FEATURE (5)..(5): X is I, L or V
  MISC_FEATURE (6)..(6): X is A or G
  MISC_FEATURE (7)..(7): X is F, W or Y for aromatic amino acids
  MISC_FEATURE (8)..(8): X is I, L or V
  MISC_FEATURE (9)..(9): X is N or Q for amidated amino acids
  MISC_FEATURE (10)..(10): X is D and E for acidic amino acids
  MISC_FEATURE (11)..(11): X is A and G
  MISC_FEATURE (12)..(12): X is A and G
  MISC_FEATURE (13)..(13): X is A and G
  MISC_FEATURE (14)..(14): X is D and E for acidic amino acids
  MISC_FEATURE (15)..(15): X is I, L or V
  MISC_FEATURE (16)..(16): X is I, L or V
  MISC_FEATURE (17)..(17): X is K, R or H for basic amino acids
  MISC_FEATURE (18)..(18): X is N or Q for amidated amino acids
  MISC_FEATURE (19)..(19): X is A and G
  MISC_FEATURE (20)..(20): X is D and E for acidic amino acids
  MISC_FEATURE (21)..(21): X is K, R or H for basic amino acids
  MISC_FEATURE (22)..(22): X is I, L or V
  MISC_FEATURE (23)..(23): X is D and E for acidic amino acids
  MISC_FEATURE (24)..(24): X is K, R or H for basic amino acids
  MISC_FEATURE (25)..(25): X is I, L or V
  MISC_FEATURE (26)..(26): X is D and E for acidic amino acids
XXXXXXXXXXXXXXXXXXXXXXXXXX

SEQ ID NO: 424 - protein, 26 aa, Artificial
  Completely synthesized peptide construct
DRSTKVIDFHGGGDLLKNGERIEKVE

SEQ ID NO: 425 - protein, 26 aa, Artificial
  peptide construct
  MISC_FEATURE (1)..(1): X is D and E for acidic amino acids
  MISC_FEATURE (2)..(2): X is K, R or H for basic amino acids
  MISC_FEATURE (3)..(3): X is C or S
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is I, L or V
  MISC_FEATURE (8)..(8): X is D and E for acidic amino acids
  MISC_FEATURE (9)..(9): X is F, W or Y for aromatic amino acids
  MISC_FEATURE (10)..(10): X is K, R or H for basic amino acids
  MISC_FEATURE (11)..(11): X is A and G
  MISC_FEATURE (12)..(12): X is A and G
  MISC_FEATURE (13)..(13): X is A and G
  MISC_FEATURE (14)..(14): X is D and E for acidic amino acids
  MISC_FEATURE (15)..(15): X is I, L or V
  MISC_FEATURE (16)..(16): X is I, L or V
  MISC_FEATURE (17)..(17): X is K, R or H for basic amino acids
  MISC_FEATURE (18)..(18): X is N or Q for amidated amino acids
  MISC_FEATURE (19)..(19): X is A and G
  MISC_FEATURE (20)..(20): X is D and E for acidic amino acids
  MISC_FEATURE (21)..(21): X is K, R or H for basic amino acids
  MISC_FEATURE (22)..(22): X is I, L or V
  MISC_FEATURE (23)..(23): X is D and E for acidic amino acids
  MISC_FEATURE (24)..(24): X is K, R or H for basic amino acids
  MISC_FEATURE (25)..(25): X is I, L or V
  MISC_FEATURE (26)..(26): X is D and E for acidic amino acids
XXXXXXXXXXXXXXXXXXXXXXXXXX

SEQ ID NO: 426 - protein, 29 aa, Artificial
  peptide construct
  MISC_FEATURE (1)..(1): X is I, L or V
  MISC_FEATURE (2)..(2): X is  A or G
  MISC_FEATURE (3)..(3): X is  A or G
  MISC_FEATURE (4)..(4): X is F, W or Y for aromatic amino acids
  MISC_FEATURE (5)..(5): X is K, R or H for basic amino acids
  MISC_FEATURE (6)..(6): X is A or G
  MISC_FEATURE (7)..(7): X is D and E for acidic amino acids
  MISC_FEATURE (8)..(8): X is N or Q for amidated amino acids
  MISC_FEATURE (9)..(9): X is A or G
  MISC_FEATURE (10)..(10): X is F or P
  MISC_FEATURE (11)..(11): X is K, R or H for basic amino acids
  MISC_FEATURE (12)..(12): X is A or G
  MISC_FEATURE (13)..(13): X is D and E for acidic amino acids
  MISC_FEATURE (14)..(14): X is A and G
  MISC_FEATURE (15)..(15): X is A and G
  MISC_FEATURE (16)..(16): X is A and G
  MISC_FEATURE (17)..(17): X is D and E for acidic amino acids
  MISC_FEATURE (18)..(18): X is I, L or V
  MISC_FEATURE (19)..(19): X is I, L or V
  MISC_FEATURE (20)..(20): X is K, R or H for basic amino acids
  MISC_FEATURE (21)..(21): X is N or Q for amidated amino acids
  MISC_FEATURE (22)..(22): X is A and G
  MISC_FEATURE (23)..(23): X is D and E for acidic amino acids
  MISC_FEATURE (24)..(24): X is K, R or H for basic amino acids
  MISC_FEATURE (25)..(25): X is I, L or V
  MISC_FEATURE (26)..(26): X is D and E for acidic amino acids
  MISC_FEATURE (27)..(27): X is K, R or H for basic amino acids
  MISC_FEATURE (28)..(28): X is I, L or V
  MISC_FEATURE (29)..(29): X is D and E for acidic amino acids
XXXXXXXXXXXXXXXXXXXXXXXXXXXXX

SEQ ID NO: 427 - protein, 16 aa, Artificial
  Completely synthesized peptide construct
GGGDLLKNGERIEKVE

SEQ ID NO: 428 - protein, 16 aa, Artificial
  peptide construct
  MISC_FEATURE (1)..(1): X is A and G
  MISC_FEATURE (2)..(2): X is A and G
  MISC_FEATURE (3)..(3): X is A and G
  MISC_FEATURE (4)..(4): X is D and E for acidic amino acids
  MISC_FEATURE (5)..(5): X is I, L or V
  MISC_FEATURE (6)..(6): X is I, L or V
  MISC_FEATURE (7)..(7): X is K, R or H for basic amino acids
  MISC_FEATURE (8)..(8): X is N or Q for amidated amino acids
  MISC_FEATURE (9)..(9): X is A and G
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is K, R or H for basic amino acids
  MISC_FEATURE (15)..(15): X is I, L or V
  MISC_FEATURE (16)..(16): X is D and E for acidic amino acids
XXXXXXXXXXXXXXXX

SEQ ID NO: 429 - protein, 24 aa, Artificial
  Completely synthesized peptide construct
KNIVTPRTGGGDLLKNGERIEKVE

SEQ ID NO: 430 - protein, 24 aa, Artificial
  peptide construct
  MISC_FEATURE (1)..(1): X is K, R or H for basic amino acids
  MISC_FEATURE (2)..(2): X is N or Q for amidated amino acids
  MISC_FEATURE (3)..(3): X is I, L or V
  MISC_FEATURE (4)..(4): X is I, L or V
  MISC_FEATURE (5)..(5): X is T or S
  MISC_FEATURE (6)..(6): X is F or P
  MISC_FEATURE (7)..(7): X is K, R or H for basic amino acids
  MISC_FEATURE (8)..(8): X is T or S
  MISC_FEATURE (9)..(9): X is A and G
  MISC_FEATURE (10)..(10): X is A and G
  MISC_FEATURE (11)..(11): X is A and G
  MISC_FEATURE (12)..(12): X is D and E for acidic amino acids
  MISC_FEATURE (13)..(13): X is I, L or V
  MISC_FEATURE (14)..(14): X is I, L or V
  MISC_FEATURE (15)..(15): X is K, R or H for basic amino acids
  MISC_FEATURE (16)..(16): X is N or Q for amidated amino acids
  MISC_FEATURE (17)..(17): X is A and G
  MISC_FEATURE (18)..(18): X is D and E for acidic amino acids
  MISC_FEATURE (19)..(19): X is K, R or H for basic amino acids
  MISC_FEATURE (20)..(20): X is I, L or V
  MISC_FEATURE (21)..(21): X is D and E for acidic amino acids
  MISC_FEATURE (22)..(22): X is K, R or H for basic amino acids
  MISC_FEATURE (23)..(23): X is I, L or V
  MISC_FEATURE (24)..(24): X is D and E for acidic amino acids
XXXXXXXXXXXXXXXXXXXXXXXX

SEQ ID NO: 431 - protein, 31 aa, Artificial
  Completely synthesized peptide construct
GDKVSFFCKNKEKKCGGGDLLKNGERIEKVE

SEQ ID NO: 432 - protein, 31 aa, Artificial; identical to SEQ ID NO: 123
  peptide construct
  MISC_FEATURE (1)..(1): X is A or G
  MISC_FEATURE (2)..(2): X is D and E for acidic amino acids
  MISC_FEATURE (3)..(3): X is K, R or H for basic amino acids
  MISC_FEATURE (4)..(4): X is I, L or V
  MISC_FEATURE (5)..(5): X is C or S
  MISC_FEATURE (6)..(6): X is F, W or Y for aromatic amino acids
  MISC_FEATURE (7)..(7): X is F, W or Y for aromatic amino acids
  MISC_FEATURE (8)..(8): X is C or S
  MISC_FEATURE (9)..(9): X is K, R or H for basic amino acids
  MISC_FEATURE (10)..(10): X is N or Q for amidated amino acids
  MISC_FEATURE (11)..(11): X is K, R or H for basic amino acids
  MISC_FEATURE (12)..(12): X is D and E for acidic amino acids
  MISC_FEATURE (13)..(13): X is K, R or H for basic amino acids
  MISC_FEATURE (14)..(14): X is K, R or H for basic amino acids
  MISC_FEATURE (15)..(15): X is C or S
  MISC_FEATURE (16)..(16): X is A and G
  MISC_FEATURE (17)..(17): X is A and G
  MISC_FEATURE (18)..(18): X is A and G
  MISC_FEATURE (19)..(19): X is D and E for acidic amino acids
  MISC_FEATURE (20)..(20): X is I, L or V
  MISC_FEATURE (21)..(21): X is I, L or V
  MISC_FEATURE (22)..(22): X is K, R or H for basic amino acids
  MISC_FEATURE (23)..(23): X is N or Q for amidated amino acids
  MISC_FEATURE (24)..(24): X is A and G
  MISC_FEATURE (25)..(25): X is D and E for acidic amino acids
  MISC_FEATURE (26)..(26): X is K, R or H for basic amino acids
  MISC_FEATURE (27)..(27): X is I, L or V
  MISC_FEATURE (28)..(28): X is D and E for acidic amino acids
  MISC_FEATURE (29)..(29): X is K, R or H for basic amino acids
  MISC_FEATURE (30)..(30): X is I, L or V
  MISC_FEATURE (31)..(31): X is D and E for acidic amino acids

SEQ ID NO: 433 - protein, 33 aa, Artificial
  Completely synthesized peptide construct
EIIVTHFPFDEQNCSMKGGGDLLKNGERIEKVE

SEQ ID NO: 434 - protein, 33 aa, Artificial; identical to SEQ ID NO: 97
  peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is I, L or V
  MISC_FEATURE (5)..(5): X is T or S
  MISC_FEATURE (6)..(6): X is K, R or H for basic amino acids
  MISC_FEATURE (7)..(7): X is F, W or Y for aromatic amino acids
  MISC_FEATURE (8)..(8): X is F or P
  MISC_FEATURE (9)..(9): X is F, W or Y for aromatic amino acids
  MISC_FEATURE (10)..(10): X is D and E for acidic amino acids
  MISC_FEATURE (11)..(11): X is D and E for acidic amino acids
  MISC_FEATURE (12)..(12): X is N or Q for amidated amino acids
  MISC_FEATURE (13)..(13): X is N or Q for amidated amino acids
  MISC_FEATURE (14)..(14): X is C or S
  MISC_FEATURE (15)..(15): X is C or S
  MISC_FEATURE (16)..(16): X is M or Nle
  MISC_FEATURE (17)..(17): X is K, R or H for basic amino acids
  MISC_FEATURE (18)..(18): X  is A and G
  MISC_FEATURE (19)..(19): X is A and G
  MISC_FEATURE (20)..(20): X is A and G
  MISC_FEATURE (21)..(21): X is D and E for acidic amino acids
  MISC_FEATURE (22)..(22): X is I, L or V
  MISC_FEATURE (23)..(23): X is I, L or V
  MISC_FEATURE (24)..(24): X is K, R or H for basic amino acids
  MISC_FEATURE (25)..(25): X is N or Q for amidated amino acids
  MISC_FEATURE (26)..(26): X is A and G
  MISC_FEATURE (27)..(27): X is D and E for acidic amino acids
  MISC_FEATURE (28)..(28): X is K, R or H for basic amino acids
  MISC_FEATURE (29)..(29): X is I, L or V
  MISC_FEATURE (30)..(30): X is D and E for acidic amino acids
  MISC_FEATURE (31)..(31): X is K, R or H for basic amino acids
  MISC_FEATURE (32)..(32): X is I, L or V
  MISC_FEATURE (33)..(33): X is D and E for acidic amino acids

SEQ ID NO: 435 - protein, 29 aa, Artificial
  Completely synthesized peptide construct
VHFFKNIVTPRTPGGGDLLKNGERIEKVE

SEQ ID NO: 436 - protein, 29 aa, Artificial
  peptide construct
  MISC_FEATURE (1)..(1): X is I, L or V
  MISC_FEATURE (2)..(2): X is K, R or H for basic amino acids
  MISC_FEATURE (3)..(3): X is F, W or Y for aromatic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is N or Q for amidated amino acids
  MISC_FEATURE (7)..(7): X is I, L or V
  MISC_FEATURE (8)..(8): X is I, L or V
  MISC_FEATURE (9)..(9): X is T or S
  MISC_FEATURE (10)..(10): X is F or P
  MISC_FEATURE (11)..(11): X is K, R or H for basic amino acids
  MISC_FEATURE (12)..(12): X is T or S
  MISC_FEATURE (13)..(13): X is F or P
  MISC_FEATURE (14)..(14): X is A and G
  MISC_FEATURE (15)..(15): X is A and G
  MISC_FEATURE (16)..(16): X is A and G
  MISC_FEATURE (17)..(17): X is D and E for acidic amino acids
  MISC_FEATURE (18)..(18): X is I, L or V
  MISC_FEATURE (19)..(19): X is I, L or V
  MISC_FEATURE (20)..(20): X is K, R or H for basic amino acids
  MISC_FEATURE (21)..(21): X is N or Q for amidated amino acids
  MISC_FEATURE (22)..(22): X is A and G
  MISC_FEATURE (23)..(23): X is D and E for acidic amino acids
  MISC_FEATURE (24)..(24): X is K, R or H for basic amino acids
  MISC_FEATURE (25)..(25): X is I, L or V
  MISC_FEATURE (26)..(26): X is D and E for acidic amino acids
  MISC_FEATURE (27)..(27): X is K, R or H for basic amino acids
  MISC_FEATURE (28)..(28): X is I, L or V
  MISC_FEATURE (29)..(29): X is D and E for acidic amino acids
XXXXXXXXXXXXXXXXXXXXXXXXXXXXX

SEQ ID NO: 437 - protein, 33 aa, Artificial
  Completely synthesized peptide construct
YQQLNSERGVPNENIENGGGDLLKNGERIEKVE

SEQ ID NO: 438 - protein, 33 aa, Artificial; identical to SEQ ID NO: 97
  peptide construct
  MISC_FEATURE (1)..(1): X is F, W or Y for aromatic amino acids
  MISC_FEATURE (2)..(2): X is N or Q for amidated amino acids
  MISC_FEATURE (3)..(3): X is N or Q for amidated amino acids
  MISC_FEATURE (4)..(4): X is I, L or V
  MISC_FEATURE (5)..(5): X is N or Q for amidated amino acids
  MISC_FEATURE (6)..(6): X is C or S
  MISC_FEATURE (7)..(7): X is D and E for acidic amino acids
  MISC_FEATURE (8)..(8): X is K, R or H for basic amino acids
  MISC_FEATURE (9)..(9): X is A or G
  MISC_FEATURE (10)..(10): X is I, L or V
  MISC_FEATURE (11)..(11): X is F or P
  MISC_FEATURE (12)..(12): X is N or Q for amidated amino acids
  MISC_FEATURE (13)..(13): X is D and E for acidic amino acids
  MISC_FEATURE (14)..(14): X is N or Q for amidated amino acids
  MISC_FEATURE (15)..(15): X is I, L or V
  MISC_FEATURE (16)..(16): X is D and E for acidic amino acids
  MISC_FEATURE (17)..(17): X is N or Q for amidated amino acids
  MISC_FEATURE (18)..(18): X is A and G
  MISC_FEATURE (19)..(19): X is A and G
  MISC_FEATURE (20)..(20): X is A and G
  MISC_FEATURE (21)..(21): X is D and E for acidic amino acids
  MISC_FEATURE (22)..(22): X is I, L or V
  MISC_FEATURE (23)..(23): X is I, L or V
  MISC_FEATURE (24)..(24): X is K, R or H for basic amino acids
  MISC_FEATURE (25)..(25): X is N or Q for amidated amino acids
  MISC_FEATURE (26)..(26): X is A and G
  MISC_FEATURE (27)..(27): X is D and E for acidic amino acids
  MISC_FEATURE (28)..(28): X is K, R or H for basic amino acids
  MISC_FEATURE (29)..(29): X is I, L or V
  MISC_FEATURE (30)..(30): X is D and E for acidic amino acids
  MISC_FEATURE (31)..(31): X is K, R or H for basic amino acids
  MISC_FEATURE (32)..(32): X is I, L or V
  MISC_FEATURE (33)..(33): X is D and E for acidic amino acids

SEQ ID NO: 439 - protein, 29 aa, Artificial
  Completely synthesized peptide construct
VFIKRVSNVIIHGGGGDLLKNGERIEKVE

SEQ ID NO: 440 - protein, 29 aa, Artificial
  peptide construct
  MISC_FEATURE (1)..(1): X is I, L or V
  MISC_FEATURE (2)..(2): X is F, W or Y for aromatic amino acids
  MISC_FEATURE (3)..(3): X is I, L or V
  MISC_FEATURE (4)..(4): X is K, R or H for basic amino acids
  MISC_FEATURE (5)..(5): X is K, R or H for basic amino acids
  MISC_FEATURE (6)..(6): X is I, L or V
  MISC_FEATURE (7)..(7): X is C or S
  MISC_FEATURE (8)..(8): X is N or Q for amidated amino acids
  MISC_FEATURE (9)..(9): X is I, L or V
  MISC_FEATURE (10)..(10): X is I, L or V
  MISC_FEATURE (11)..(11): X is I, L or V
  MISC_FEATURE (12)..(12): X is K, R or H for basic amino acids
  MISC_FEATURE (13)..(13): X is A or G
  MISC_FEATURE (14)..(14): X is A and G
  MISC_FEATURE (15)..(15): X is A and G
  MISC_FEATURE (16)..(16): X is A and G
  MISC_FEATURE (17)..(17): X is D and E for acidic amino acids
  MISC_FEATURE (18)..(18): X is I, L or V
  MISC_FEATURE (19)..(19): X is I, L or V
  MISC_FEATURE (20)..(20): X is  K, R or H for basic amino acids
  MISC_FEATURE (21)..(21): X is N or Q for amidated amino acids
  MISC_FEATURE (22)..(22): X is A and G
  MISC_FEATURE (23)..(23): X is D and E for acidic amino acids
  MISC_FEATURE (24)..(24): X is K, R or H for basic amino acids
  MISC_FEATURE (25)..(25): X is I, L or V
  MISC_FEATURE (26)..(26): X is D and E for acidic amino acids
  MISC_FEATURE (27)..(27): X is K, R or H for basic amino acids
  MISC_FEATURE (28)..(28): X is I, L or V
  MISC_FEATURE (29)..(29): X is D and E for acidic amino acids
XXXXXXXXXXXXXXXXXXXXXXXXXXXXX

SEQ ID NO: 441 - protein, 31 aa, Artificial
  Completely synthesized peptide construct
MKVTVAFNQFGPNRRGGGDLLKNGERIEKVE

SEQ ID NO: 442 - protein, 31 aa, Artificial; identical to SEQ ID NO: 123
  peptide construct
  MISC_FEATURE (1)..(1): X is M or Nle
  MISC_FEATURE (2)..(2): X is K, R or H for basic amino acids
  MISC_FEATURE (3)..(3): X is I, L or V
  MISC_FEATURE (4)..(4): X is T or S
  MISC_FEATURE (5)..(5): X is I, L or V
  MISC_FEATURE (6)..(6): X is A or G
  MISC_FEATURE (7)..(7): X is F, W or Y for aromatic amino acids
  MISC_FEATURE (8)..(8): X is N or Q for amidated amino acids
  MISC_FEATURE (9)..(9): X is N or Q for amidated amino acids
  MISC_FEATURE (10)..(10): X is F, W or Y for amidated amino acids
  MISC_FEATURE (11)..(11): X is A or G
  MISC_FEATURE (12)..(12): X is F or P
  MISC_FEATURE (13)..(13): X is N or Q for amidated amino acids
  MISC_FEATURE (14)..(14): X is K, R or H for basic amino acids
  MISC_FEATURE (15)..(15): X is K, R or H for basic amino acids
  MISC_FEATURE (16)..(16): X is A and G
  MISC_FEATURE (17)..(17): X is A and G
  MISC_FEATURE (18)..(18): X is A and G
  MISC_FEATURE (19)..(19): X is D and E for acidic amino acids
  MISC_FEATURE (20)..(20): X is I, L or V
  MISC_FEATURE (21)..(21): X is I, L or V
  MISC_FEATURE (22)..(22): X is K, R or H for basic amino acids
  MISC_FEATURE (23)..(23): X is N or Q for amidated amino acids
  MISC_FEATURE (24)..(24): X is A and G
  MISC_FEATURE (25)..(25): X is D and E for acidic amino acids
  MISC_FEATURE (26)..(26): X is K, R or H for basic amino acids
  MISC_FEATURE (27)..(27): X is I, L or V
  MISC_FEATURE (28)..(28): X is D and E for acidic amino acids
  MISC_FEATURE (29)..(29): X is K, R or H for basic amino acids
  MISC_FEATURE (30)..(30): X is I, L or V
  MISC_FEATURE (31)..(31): X is D and E for acidic amino acids

SEQ ID NO: 443 - protein, 31 aa, Artificial
  Completely synthesized peptide construct
IASRRVDGIIAAYQNGGGDLLKNGERIEKVE

SEQ ID NO: 444 - protein, 31 aa, Artificial; identical to SEQ ID NO: 123
  peptide construct
  MISC_FEATURE (1)..(1): X is I, L or V
  MISC_FEATURE (2)..(2): X is A or G
  MISC_FEATURE (3)..(3): X is C or S
  MISC_FEATURE (4)..(4): X is K, R or H for basic amino acids
  MISC_FEATURE (5)..(5): X is K, R or H for basic amino acids
  MISC_FEATURE (6)..(6): X is I, L or V
  MISC_FEATURE (7)..(7): X is D and E for acidic amino acids
  MISC_FEATURE (8)..(8): X is A or G
  MISC_FEATURE (9)..(9): X is I, L or V
  MISC_FEATURE (10)..(10): X is I, L or V
  MISC_FEATURE (11)..(11): X is A or G
  MISC_FEATURE (12)..(12): X is A or G
  MISC_FEATURE (13)..(13): X is F, W or Y for aromatic amino acids
  MISC_FEATURE (14)..(14): X is N or Q for amidated amino acids
  MISC_FEATURE (15)..(15): X is N or Q for amidated amino acids
  MISC_FEATURE (16)..(16): X is A and G
  MISC_FEATURE (17)..(17): X is A and G
  MISC_FEATURE (18)..(18): X is A and G
  MISC_FEATURE (19)..(19): X is D and E for acidic amino acids
  MISC_FEATURE (20)..(20): X is I, L or V
  MISC_FEATURE (21)..(21): X is I, L or V
  MISC_FEATURE (22)..(22): X is K, R or H for basic amino acids
  MISC_FEATURE (23)..(23): X is N or Q for amidated amino acids
  MISC_FEATURE (24)..(24): X is A and G
  MISC_FEATURE (25)..(25): X is D and E for acidic amino acids
  MISC_FEATURE (26)..(26): X is K, R or H for basic amino acids
  MISC_FEATURE (27)..(27): X is I, L or V
  MISC_FEATURE (28)..(28): X is D and E for acidic amino acids
  MISC_FEATURE (29)..(29): X is K, R or H for basic amino acids
  MISC_FEATURE (30)..(30): X is I, L or V
  MISC_FEATURE (31)..(31): X is D and E for acidic amino acids

SEQ ID NO: 445 - protein, 35 aa, Artificial
  Completely synthesized peptide construct
IDIFASKNFHLQKNTIGTGGGGDLLKNGERIEKVE

SEQ ID NO: 446 - protein, 35 aa, Artificial; identical to SEQ ID NO: 197
  peptide construct
  MISC_FEATURE (1)..(1): X is I, L or V
  MISC_FEATURE (2)..(2): X is D and E for acidic amino acids
  MISC_FEATURE (3)..(3): X is I, L or V
  MISC_FEATURE (4)..(4): X is F, W or Y for aromatic amino acids
  MISC_FEATURE (5)..(5): X is A or G
  MISC_FEATURE (6)..(6): X is C or S
  MISC_FEATURE (7)..(7): X is K, R or H for basic amino acids
  MISC_FEATURE (8)..(8): X is N or Q for amidated amino acids
  MISC_FEATURE (9)..(9): X is F, W or Y for aromatic amino acids
  MISC_FEATURE (10)..(10): X is K, R or H for basic amino acids
  MISC_FEATURE (11)..(11): X is I, L or V
  MISC_FEATURE (12)..(12): X is N or Q for amidated amino acids
  MISC_FEATURE (13)..(13): X is K, R or H for basic amino acids
  MISC_FEATURE (14)..(14): X is N or Q for amidated amino acids
  MISC_FEATURE (15)..(15): X is T or S
  MISC_FEATURE (16)..(16): X is I, L or V
  MISC_FEATURE (17)..(17): X is A or G
  MISC_FEATURE (18)..(18): X is T or S
  MISC_FEATURE (19)..(19): X is A or G
  MISC_FEATURE (20)..(20): X is A and G
  MISC_FEATURE (21)..(21): X is A and G
  MISC_FEATURE (22)..(22): X is A and G
  MISC_FEATURE (23)..(23): X is D and E for acidic amino acids
  MISC_FEATURE (24)..(24): X is I, L or V
  MISC_FEATURE (25)..(25): X is I, L or V
  MISC_FEATURE (26)..(26): X is K, R or H for basic amino acids
  MISC_FEATURE (27)..(27): X is N or Q for amidated amino acids
  MISC_FEATURE (28)..(28): X is A and G
  MISC_FEATURE (29)..(29): X is D and E for acidic amino acids
  MISC_FEATURE (30)..(30): X is K, R or H for basic amino acids
  MISC_FEATURE (31)..(31): X is I, L or V
  MISC_FEATURE (32)..(32): X is D and E for acidic amino acids
  MISC_FEATURE (33)..(33): X is K, R or H for basic amino acids
  MISC_FEATURE (34)..(34): X is I, L or V
  MISC_FEATURE (35)..(35): X is D and E for acidic amino acids

SEQ ID NO: 447 - protein, 41 aa, Artificial
  Completely synthesized peptide construct
GIGAVLKVLTTGPALISWIKRKRQQGGGDLLKNGERIEKVE

SEQ ID NO: 448 - protein, 41 aa, Artificial; identical to SEQ ID NO: 370
  Completely synthesized peptide construct
  MISC_FEATURE (1)..(1): X is A or G
  MISC_FEATURE (2)..(2): X is I, L or V
  MISC_FEATURE (3)..(3): X is A or G
  MISC_FEATURE (4)..(4): X is A or G
  MISC_FEATURE (5)..(5): X is I, L or V
  MISC_FEATURE (6)..(6): X is I, L or V
  MISC_FEATURE (7)..(7): X is K, R or H for basic amino acids
  MISC_FEATURE (8)..(8): X is I, L or V
  MISC_FEATURE (9)..(9): X is I, L or V
  MISC_FEATURE (10)..(10): X is T or S
  MISC_FEATURE (11)..(11): X is T or S
  MISC_FEATURE (12)..(12): X is A or G
  MISC_FEATURE (13)..(13): X is F or P
  MISC_FEATURE (14)..(14): X is A or G
  MISC_FEATURE (15)..(15): X is I, L or V
  MISC_FEATURE (16)..(16): X is I, L or V
  MISC_FEATURE (17)..(17): X is C or S
  MISC_FEATURE (18)..(18): X is F, W or Y for aromatic amino acids
  MISC_FEATURE (19)..(19): X is I, L or V
  MISC_FEATURE (20)..(20): X is K, R or H for basic amino acids
  MISC_FEATURE (21)..(21): X is K, R or H for basic amino acids
  MISC_FEATURE (22)..(22): X is K, R or H for basic amino acids
  MISC_FEATURE (23)..(23): X is K, R or H for basic amino acids
  MISC_FEATURE (24)..(24): X is N or Q for amidated amino acids
  MISC_FEATURE (25)..(25): X is N or Q for amidated amino acids
  MISC_FEATURE (26)..(26): X is A and G
  MISC_FEATURE (27)..(27): X is A and G
  MISC_FEATURE (28)..(28): X is A and G
  MISC_FEATURE (29)..(29): X is D and E for acidic amino acids
  MISC_FEATURE (30)..(30): X is I, L or V
  MISC_FEATURE (31)..(31): X is I, L or V
  MISC_FEATURE (32)..(32): X is K, R or H for basic amino acids
  MISC_FEATURE (33)..(33): X is N or Q for amidated amino acids
  MISC_FEATURE (34)..(34): X is A and G
  MISC_FEATURE (35)..(35): X is D and E for acidic amino acids
  MISC_FEATURE (36)..(36): X is K, R or H for basic amino acids
  MISC_FEATURE (37)..(37): X is I, L or V
  MISC_FEATURE (38)..(38): X is D and E for acidic amino acids
  MISC_FEATURE (39)..(39): X is K, R or H for basic amino acids
  MISC_FEATURE (40)..(40): X is I, L or V
  MISC_FEATURE (41)..(41): X is D and E for acidic amino acids

SEQ ID NO: 449 - protein, 21 aa, Homo sapiens
VSSVSSQFSDAAQASPSSHSS

SEQ ID NO: 450 - protein, 21 aa, Artificial
  Completely synthesized peptide construct
  MISC_FEATURE (1)..(1): X is I, L or V
  MISC_FEATURE (2)..(2): X is T or S
  MISC_FEATURE (3)..(3): X is T or S
  MISC_FEATURE (4)..(4): X is I, L or V
  MISC_FEATURE (5)..(5): X is T or S
  MISC_FEATURE (6)..(6): X is T or S
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is D and E for acidic amino acids
  MISC_FEATURE (11)..(11): X is A and G
  MISC_FEATURE (12)..(12): X is A and g
  MISC_FEATURE (13)..(13): X is T or S
  MISC_FEATURE (14)..(14): X is A and G
  MISC_FEATURE (15)..(15): X is T or S
  MISC_FEATURE (16)..(16): X is F or P
  MISC_FEATURE (17)..(17): X is T or S
  MISC_FEATURE (18)..(18): X is T or S
  MISC_FEATURE (19)..(19): X is K, R or H for basic amino acids
  MISC_FEATURE (20)..(20): X is T or S
  MISC_FEATURE (21)..(21): X is T or S
XXXXXXXXXXXXXXXXXXXXX

SEQ ID NO: 451 - protein, 22 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is I, L or V
  MISC_FEATURE (3)..(3): X is T or S
  MISC_FEATURE (4)..(4): X is T or S
  MISC_FEATURE (5)..(5): X is I, L or V
  MISC_FEATURE (6)..(6): X is T or S
  MISC_FEATURE (7)..(7): X is T or S
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is D and E for acidic amino acids
  MISC_FEATURE (12)..(12): X is A and G
  MISC_FEATURE (13)..(13): X is A and G
  MISC_FEATURE (14)..(14): X is T or S
  MISC_FEATURE (15)..(15): X is A and G
  MISC_FEATURE (16)..(16): X is T or S
  MISC_FEATURE (17)..(17): X is F or P
  MISC_FEATURE (18)..(18): X is T or S
  MISC_FEATURE (19)..(19): X is T or S
  MISC_FEATURE (20)..(20): X is K, R or H for basic amino acids
  MISC_FEATURE (21)..(21): X is T or S
  MISC_FEATURE (22)..(22): X is T or S
XXXXXXXXXXXXXXXXXXXXXX

SEQ ID NO: 452 - protein, 21 aa, Homo sapiens
MVWESGCTVIVMLTPLVEDGV

SEQ ID NO: 453 - protein, 21 aa, Artificial
  Completely synthesized peptide construct
  MISC_FEATURE (1)..(1): X is M or Nle (Norleucine)
  MISC_FEATURE (2)..(2): X is I, L or V
  MISC_FEATURE (3)..(3): X is F, W or Y for aromatic amino acids
  MISC_FEATURE (4)..(4): X is D and E for acidic amino acids
  MISC_FEATURE (5)..(5): X is T or S
  MISC_FEATURE (6)..(6): X is A and G
  MISC_FEATURE (7)..(7): X is C or S
  MISC_FEATURE (8)..(8): X is T or S
  MISC_FEATURE (9)..(9): X is I, L or V
  MISC_FEATURE (10)..(10): X is I, L or V
  MISC_FEATURE (11)..(11): X is I, L or V
  MISC_FEATURE (12)..(12): X is M or Nle (Norleucine)
  MISC_FEATURE (13)..(13): X is I, L or V
  MISC_FEATURE (14)..(14): X is I, L or V
  MISC_FEATURE (15)..(15): X is F or P
  MISC_FEATURE (16)..(16): X is I, L or V
  MISC_FEATURE (17)..(17): X is I, L or V
  MISC_FEATURE (18)..(18): X is D and E for acidic amino acids
  MISC_FEATURE (19)..(19): X is D and E for acidic amino acids
  MISC_FEATURE (20)..(20): X is A and G
  MISC_FEATURE (21)..(21): X is I, L or V
XXXXXXXXXXXXXXXXXXXXX

SEQ ID NO: 454 - protein, 22 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is M or Nle (Norleucine)
  MISC_FEATURE (3)..(3): X is I, L or V
  MISC_FEATURE (4)..(4): X is F, W or Y for aromatic amino acids
  MISC_FEATURE (5)..(5): X is D and E for acidic amino acids
  MISC_FEATURE (6)..(6): X is T or S
  MISC_FEATURE (7)..(7): X is A and G
  MISC_FEATURE (8)..(8): X is C or S
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is M or Nle (Norleucine)
  MISC_FEATURE (14)..(14): X is I, L or V
  MISC_FEATURE (15)..(15): X is I, L or V
  MISC_FEATURE (16)..(16): X is F or P
  MISC_FEATURE (17)..(17): X is I, L or V
  MISC_FEATURE (18)..(18): X is I, L or V
  MISC_FEATURE (19)..(19): X is I, L or V
  MISC_FEATURE (19)..(19): X is D and E for acidic amino acids
  MISC_FEATURE (20)..(20): X is D and E for acidic amino acids
  MISC_FEATURE (21)..(21): X is A and G
  MISC_FEATURE (22)..(22): X is I, L or V
XXXXXXXXXXXXXXXXXXXXXX

SEQ ID NO: 455 - protein, 20 aa, Artificial
  Completely synthesized peptide construct
  MISC_FEATURE (1)..(1): X is M or Nle (Norleucine)
  MISC_FEATURE (2)..(2): X is I, L or V
  MISC_FEATURE (3)..(3): X is F, W or Y for aromatic amino acids
  MISC_FEATURE (4)..(4): X is D and E for acidic amino acids
  MISC_FEATURE (5)..(5): X is T or S
  MISC_FEATURE (6)..(6): X is A and G
  MISC_FEATURE (7)..(7): X is C or S
  MISC_FEATURE (8)..(8): X is T or S
  MISC_FEATURE (9)..(9): X is Gaba2 for X2X3 or X3X3 or X2X3 or X3X2 or X3X3 or X2X2
  MISC_FEATURE (10)..(10): X is I, L or V
  MISC_FEATURE (11)..(11): X is M or Nle (Norleucine)
  MISC_FEATURE (12)..(12): X is I, L or V
  MISC_FEATURE (13)..(13): X is I, L or V
  MISC_FEATURE (14)..(14): X is F or P
  MISC_FEATURE (15)..(15): X is I, L or V
  MISC_FEATURE (16)..(16): X is I, L or V
  MISC_FEATURE (17)..(17): X is D and E or acidic amino acids
  MISC_FEATURE (18)..(18): X is D and E or acidic amino acids
  MISC_FEATURE (19)..(19): X is A and G
  MISC_FEATURE (20)..(20): X is I, L or V
XXXXXXXXXXXXXXXXXXXX

SEQ ID NO: 456 - protein, 20 aa, Artificial
  Completely synthesized peptide construct
  MISC_FEATURE (1)..(1): X is M or Nle (Norleucine)
  MISC_FEATURE (2)..(2): X is I, L or V
  MISC_FEATURE (3)..(3): X is F, W or Y for aromatic amino acids
  MISC_FEATURE (4)..(4): X is D and E for acidic amino acids
  MISC_FEATURE (5)..(5): X is T or S
  MISC_FEATURE (6)..(6): X is A and G
  MISC_FEATURE (7)..(7): X is C or S
  MISC_FEATURE (8)..(8): X is T or s
  MISC_FEATURE (9)..(9): X is I, L or V
  MISC_FEATURE (10)..(10): X is Gaba2 for X2X3 or X3X2 or X2X3 or X3X2 or X3X3 or X2X2
  MISC_FEATURE (11)..(11): X is M or Nle (Norleucine)
  MISC_FEATURE (12)..(12): X is I, L or V
  MISC_FEATURE (13)..(13): X is I, L or V
  MISC_FEATURE (14)..(14): X is F or P
  MISC_FEATURE (15)..(15): X is I, L or V
  MISC_FEATURE (16)..(16): X is I, L or V
  MISC_FEATURE (17)..(17): X is D and E for acidic amino acids
  MISC_FEATURE (18)..(18): X is D and E for acidic amino acids
  MISC_FEATURE (19)..(19): X is A and G
  MISC_FEATURE (20)..(20): X is I, L or V
XXXXXXXXXXXXXXXXXXXX

SEQ ID NO: 457 - protein, 20 aa, Artificial
  Completely synthesized peptide construct
  MISC_FEATURE (1)..(1): X is M or Nle (Norleucine)
  MISC_FEATURE (2)..(2): X is I, L or V
  MISC_FEATURE (3)..(3): X is F, W or Y for aromatic amino acids
  MISC_FEATURE (4)..(4): X is D and E for acidic amino acids
  MISC_FEATURE (5)..(5): X is T or S
  MISC_FEATURE (6)..(6): X is A and G
  MISC_FEATURE (7)..(7): X is C or S
  MISC_FEATURE (8)..(8): X is T or S
  MISC_FEATURE (9)..(9): X is I, L or V
  MISC_FEATURE (10)..(10): X is I, L or V
  MISC_FEATURE (11)..(11): X is I, L or V
  MISC_FEATURE (12)..(12): X is I, L or V
  MISC_FEATURE (12)..(12): X is M or Nle (Norleucine)
  MISC_FEATURE (13)..(13): X is I, L or V
  MISC_FEATURE (14)..(14): X is I, L or V
  MISC_FEATURE (15)..(15): X is F or P
  MISC_FEATURE (16)..(16): X is I, L or V
  MISC_FEATURE (17)..(17): X is I, L or V
  MISC_FEATURE (18)..(18): X is Gaba2 for X2X3 or X3X2 or X2X3 or X3X2 or X3X3 or X2X2
  MISC_FEATURE (19)..(19): X is A and G
  MISC_FEATURE (20)..(20): X is I, L or V
XXXXXXXXXXXXXXXXXXXX

SEQ ID NO: 458 - protein, 19 aa, Artificial
  Completely synthesized peptide construct
  MISC_FEATURE (1)..(1): X is M or Nle (Norleucine)
  MISC_FEATURE (2)..(2): X is I, L or V
  MISC_FEATURE (3)..(3): X is F, W or Y for aromatic amino acids
  MISC_FEATURE (4)..(4): X is D and E for acidic amino acids
  MISC_FEATURE (5)..(5): X is T or S
  MISC_FEATURE (6)..(6): X is A and G
  MISC_FEATURE (7)..(7): X is C or S
  MISC_FEATURE (8)..(8): X is T or S
  MISC_FEATURE (9)..(9): X is 5-aminopentanoic acid for replacement of 3 or 4 amino acids of X2 and X3
  MISC_FEATURE (10)..(10): X is M or Nle (Norleucine)
  MISC_FEATURE (11)..(11): X is I, L or V
  MISC_FEATURE (12)..(12): X is I, L or V
  MISC_FEATURE (13)..(13): X is F or P
  MISC_FEATURE (14)..(14): X is I, L or V
  MISC_FEATURE (15)..(15): X is I, L or V
  MISC_FEATURE (16)..(16): X is D and E for acidic amino acids
  MISC_FEATURE (17)..(17): X is D and E for acidic amino acids
  MISC_FEATURE (18)..(18): X is A and G
  MISC_FEATURE (19)..(19): X is I, L or V
XXXXXXXXXXXXXXXXXXX

SEQ ID NO: 459 - protein, 18 aa, Artificial
  Completely synthesized peptide construct
  MISC_FEATURE (1)..(1): X is M or Nle (Norleucine)
  MISC_FEATURE (2)..(2): X is I, L or V
  MISC_FEATURE (3)..(3): X is F, W or Y for aromatic amino acids
  MISC_FEATURE (4)..(4): X is D and E for acidic amino acids
  MISC_FEATURE (5)..(5): X is T or S
  MISC_FEATURE (6)..(6): X is A and G
  MISC_FEATURE (7)..(7): X is C or S
  MISC_FEATURE (8)..(8): X is T or S
  MISC_FEATURE (9)..(9): X is I, L or V
  MISC_FEATURE (10)..(10): X is I, L or V
  MISC_FEATURE (11)..(11): X is I, L or V
  MISC_FEATURE (12)..(12): X is M or Nle (Norleucine)
  MISC_FEATURE (13)..(13): X is I, L or V
  MISC_FEATURE (14)..(14): X is I, L or V
  MISC_FEATURE (15)..(15): X is F or P
  MISC_FEATURE (16)..(16): X is 5-aminopentanoic acid for replacement of 3 or 4 amino acids of X2 and X3
  MISC_FEATURE (17)..(17): X is A and G
  MISC_FEATURE (18)..(18): X is I, L or V
XXXXXXXXXXXXXXXXXX

SEQ ID NO: 460 - protein, 16 aa, Artificial
  Completely synthesized peptide construct
  MISC_FEATURE (1)..(1): X is N or Q for amidated amino acids
  MISC_FEATURE (2)..(2): X is I, L or V
  MISC_FEATURE (3)..(3): X is F, W or Y for aromatic amino acids
  MISC_FEATURE (4)..(4): X is D and E for acidic amino acids
  MISC_FEATURE (5)..(5): X is T or S
  MISC_FEATURE (6)..(6): X is A and G
  MISC_FEATURE (7)..(7): X is C or S
  MISC_FEATURE (8)..(8): X is T or S
  MISC_FEATURE (9)..(9): X is 5-aminopentanoic acid for replacement of 3 or 4 amino acids of X2 and X3
  MISC_FEATURE (10)..(10): X is M or Nle (Norleucine)
  MISC_FEATURE (11)..(11): X is I, L or V
  MISC_FEATURE (12)..(12): X is I, L or V
  MISC_FEATURE (13)..(13): X is F or P
  MISC_FEATURE (14)..(14): X is 5-aminopentanoic acid for replacement of 3 or 4 amino acids of X2 and X3
  MISC_FEATURE (15)..(15): X is A and G
  MISC_FEATURE (16)..(16): X is I, L or V
XXXXXXXXXXXXXXXX

SEQ ID NO: 461 - protein, 17 aa, Artificial
  Completely synthesized peptide construct
  MISC_FEATURE (1)..(1): X is M or Nle (Norleucine)
  MISC_FEATURE (2)..(2): X is I, L or V
  MISC_FEATURE (3)..(3): X is F, W or Y for aromatic amino acids
  MISC_FEATURE (4)..(4): X is D and E for acidic amino acids
  MISC_FEATURE (5)..(5): X is T or S
  MISC_FEATURE (6)..(6): X is A and G
  MISC_FEATURE (7)..(7): X is C or S
  MISC_FEATURE (8)..(8): X is T or S
  MISC_FEATURE (9)..(9): X is Gaba2 for X2X3 or X3X2 or X2X3 or X3X2 or X3X3 or X2X2
  MISC_FEATURE (10)..(10): X is I, L or V
  MISC_FEATURE (11)..(11): X is M or Nle (Norleucine)
  MISC_FEATURE (12)..(12): X is Gaba2 for X2X3 or X3X2 or X2X3 or X3X2 or X3X3 or X2X2
  MISC_FEATURE (13)..(13): X is F or P
  MISC_FEATURE (14)..(14): X is Gaba2 for X2X3 or X3X2 or X2X3 or X3X2 or X3X3 or X2X2
  MISC_FEATURE (15)..(15): X is Gaba2 for X2X3 or X3X2 or X2X3 or X3X2 or X3X3 or X2X2
  MISC_FEATURE (16)..(16): X is A and G
  MISC_FEATURE (17)..(17): X is I, L or V
XXXXXXXXXXXXXXXXX

SEQ ID NO: 462 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is M or Nle (Norleucine)
  MISC_FEATURE (3)..(3): X is I, L or V
  MISC_FEATURE (4)..(4): X is F, W or Y for aromatic amino acids
  MISC_FEATURE (5)..(5): X is D and E for acidic amino acids
  MISC_FEATURE (6)..(6): X is T or S
  MISC_FEATURE (7)..(6): X is A and G
  misc_feature (7)..(7): Xaa can be any naturally occurring amino acid
  MISC_FEATURE (8)..(8): X is C or S
  MISC_FEATURE (9)..(9): X is T or S
  MISC_FEATURE (10)..(10): X is Gaba2 for X2X3 or X3X2 or X2X3 or X3X2 or X3X3 or X2X2
  MISC_FEATURE (11)..(11): X is I, L or V
  MISC_FEATURE (12)..(12): X is M or Nle (Norleucine)
  MISC_FEATURE (13)..(13): X is I, L or V
  MISC_FEATURE (14)..(14): X is I, L or V
  MISC_FEATURE (15)..(15): X is F or P
  MISC_FEATURE (16)..(16): X is I, L or V
  MISC_FEATURE (17)..(17): X is I, L or V
  MISC_FEATURE (18)..(18): X is D and E for acidic amino acids
  MISC_FEATURE (19)..(19): X is D and E for acidic amino acids
  MISC_FEATURE (20)..(20): X is A and G
  MISC_FEATURE (21)..(21): X is I, L or V
XXXXXXXXXXXXXXXXXXXXX

SEQ ID NO: 463 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is M or Nle (Norleucine)
  MISC_FEATURE (3)..(3): X is I, L or V
  MISC_FEATURE (4)..(4): X is F, W or Y for aromatic amino acids
  MISC_FEATURE (5)..(5): X is D and E for acidic amino acids
  MISC_FEATURE (6)..(6): X is T or S
  MISC_FEATURE (7)..(7): X is A and G
  MISC_FEATURE (8)..(8): X is C or S
  MISC_FEATURE (9)..(9): X is T or S
  MISC_FEATURE (10)..(10): X is I, L or V
  MISC_FEATURE (11)..(11): X is Gaba2 for X2X3 or X3X2 or X2X3 or X3X2 or X3X3 or X2X2
  MISC_FEATURE (12)..(12): X is M or Nle (Norleucine)
  MISC_FEATURE (13)..(13): X is I, L or V
  MISC_FEATURE (14)..(14): X is I, L or V
  MISC_FEATURE (15)..(15): X is F or P
  MISC_FEATURE (16)..(16): X is I, L or V
  MISC_FEATURE (17)..(17): X is I, L or V
  MISC_FEATURE (18)..(18): X is D and E for acidic amino acids
  MISC_FEATURE (19)..(19): X is D and E for acidic amino acids
  MISC_FEATURE (20)..(20): X is A and G
  MISC_FEATURE (21)..(21): X is I, L or V
XXXXXXXXXXXXXXXXXXXXX

SEQ ID NO: 464 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is M or Nle (Norleucine)
  MISC_FEATURE (3)..(3): X is I, L or V
  MISC_FEATURE (4)..(4): X is F, W or Y for aromatic amino acids
  MISC_FEATURE (5)..(5): X is D and E for acidic amino acids
  MISC_FEATURE (6)..(5): X is T or S
  misc_feature (6)..(6): Xaa can be any naturally occurring amino acid
  MISC_FEATURE (7)..(7): X is A and G
  MISC_FEATURE (8)..(8): X is C or S
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is M or Nle (Norleucine)
  MISC_FEATURE (14)..(14): X is I, L or V
  MISC_FEATURE (15)..(15): X is I, L or V
  MISC_FEATURE (16)..(16): X is F or P
  MISC_FEATURE (17)..(17): X is I, L or V
  MISC_FEATURE (18)..(18): X is I, L or V
  MISC_FEATURE (19)..(19): X is Gaba2 for X2X3 or X3X2 or X2X3 or X3X2 or X3X3 or X2X2
  MISC_FEATURE (20)..(20): X is A and G
  MISC_FEATURE (21)..(21): X is I, L or V
XXXXXXXXXXXXXXXXXXXXX

SEQ ID NO: 465 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is M or Nle (Norleucine)
  MISC_FEATURE (3)..(3): X is I, L or V
  MISC_FEATURE (4)..(4): X is F, W or Y for aromatic amino acids
  MISC_FEATURE (5)..(5): X is D and E for acidic amino acids
  MISC_FEATURE (6)..(6): X is T or S
  MISC_FEATURE (7)..(7): X is A and G
  MISC_FEATURE (8)..(8): X is C or S
  MISC_FEATURE (9)..(9): X isT or S
  MISC_FEATURE (10)..(10): X is T or S
  MISC_FEATURE (10)..(10): X is 5-aminopentanoic acid for replacement of 3 or 4 amino acids of X2 and X3
  MISC_FEATURE (11)..(11): X is M or Nle (Norleucine)
  MISC_FEATURE (12)..(12): X is I, L or V
  MISC_FEATURE (13)..(13): X is I, L or V
  MISC_FEATURE (14)..(14): X is F or P
  MISC_FEATURE (15)..(15): X is I, L or V
  MISC_FEATURE (16)..(16): X is I, L or V
  MISC_FEATURE (17)..(17): X is D and E for acidic amino acids
  MISC_FEATURE (18)..(18): X is D and E for acidic amino acids
  MISC_FEATURE (19)..(19): X is A and G
  MISC_FEATURE (20)..(20): X is I, L or V
XXXXXXXXXXXXXXXXXXXX

SEQ ID NO: 466 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is M or Nle (Norleucine)
  MISC_FEATURE (3)..(3): X is I, L or V
  MISC_FEATURE (4)..(4): X is F, W or Y for aromatic amino acids
  MISC_FEATURE (5)..(5): X is D and E for acidic amino acids
  MISC_FEATURE (6)..(6): X is T or S
  MISC_FEATURE (7)..(7): X is A and G
  MISC_FEATURE (8)..(8): X is C or S
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is M or Nle (Norleucine)
  MISC_FEATURE (14)..(14): X is I, L or V
  MISC_FEATURE (15)..(15): X is I, L or V
  MISC_FEATURE (16)..(16): X is F or P
  MISC_FEATURE (17)..(17): X is 5-aminopentanoic acid for replacement of 3 or 4 amino acids of X2 and X3
  MISC_FEATURE (18)..(18): X is A and G
  MISC_FEATURE (19)..(19): X is I, L or V
XXXXXXXXXXXXXXXXXXX

SEQ ID NO: 467 - protein, 17 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is M or Nle (Norleucine)
  MISC_FEATURE (3)..(3): X is I, L or V
  MISC_FEATURE (4)..(4): X is F, W or Y for aromatic amino acids
  MISC_FEATURE (5)..(5): X is D and E for acidic amino acids
  MISC_FEATURE (6)..(6): X is T or S
  MISC_FEATURE (7)..(6): X is A and G
  misc_feature (7)..(7): Xaa can be any naturally occurring amino acid
  MISC_FEATURE (8)..(8): X is C or S
  MISC_FEATURE (9)..(9): X is T or S
  MISC_FEATURE (10)..(10): X is 5-aminopentanoic acid for replacement of 3 or 4 amino acids of X2 and X3
  MISC_FEATURE (11)..(11): X is M or Nle (Norleucine)
  MISC_FEATURE (12)..(12): X is I, L or V
  MISC_FEATURE (13)..(13): X is I, L or V
  MISC_FEATURE (14)..(14): X is F or P
  MISC_FEATURE (15)..(15): X is 5-aminopentanoic acid for replacement of 3 or 4 amino acids of X2 or X3
  MISC_FEATURE (16)..(16): X is A and G
  MISC_FEATURE (17)..(17): X is I, L or V
XXXXXXXXXXXXXXXXX

SEQ ID NO: 468 - protein, 18 aa, Artificial
  Completely synthesized peptide construct
  MISC_FEATURE (1)..(1): X is acetyl or propionyl group, D glycine or D alaninie, cyclohexylalanine at amino terminus
  MISC_FEATURE (2)..(2): X is M or Nle (Norleucine)
  MISC_FEATURE (3)..(3): X is I, L or V
  MISC_FEATURE (4)..(4): X is F, W or Y for aromatic amino acids
  MISC_FEATURE (5)..(5): X is D and E for acidic amino acids
  MISC_FEATURE (6)..(6): X is T or S
  MISC_FEATURE (7)..(7): X is A and G
  MISC_FEATURE (8)..(8): X is C or S
  MISC_FEATURE (9)..(9): X is T or S
  MISC_FEATURE (10)..(10): X is Gaba2 for X2X3 or X3X2 or X2X3 or X3X2 or X3X3 or X2X2
  MISC_FEATURE (11)..(11): X is I, L or V
  MISC_FEATURE (12)..(12): X is M or Nle (Norleucine)
  MISC_FEATURE (13)..(13): X is A and G
  MISC_FEATURE (14)..(14): X is F or P
  MISC_FEATURE (15)..(15): X is Gaba2 for X2X3 or X3X2 or X2X3 or X3X2 or X3X3 or X2X2
  MISC_FEATURE (16)..(16): X is Gaba2 for X2X3 or X3X2 or X2X3 or X3X2 or X3X3 or X2X2
  MISC_FEATURE (17)..(17): X is A and G
  MISC_FEATURE (18)..(18): X is I, L or V
XXXXXXXXXXXXXXXXXX

SEQ ID NO: 469 - protein, 19 aa, Homo sapiens
FYLKNVQTQETRTLTQFHF

SEQ ID NO: 470 - protein, 19 aa, Artificial
  Completely synthesized peptide construct
  MISC_FEATURE (1)..(1): X is F or P
  MISC_FEATURE (2)..(2): X is F, W or Y for aromatic amino acids
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is I, L or V
  MISC_FEATURE (7)..(7): X is N or Q for amidated amino acids
  MISC_FEATURE (8)..(8): X is T or S
  MISC_FEATURE (9)..(9): X is N or Q for amidated amino acids
  MISC_FEATURE (10)..(10): X is for D and E for acidic amino acids
  MISC_FEATURE (11)..(11): X is I, L or V
  MISC_FEATURE (12)..(12): X is K, R or H for basic amino acids
  MISC_FEATURE (13)..(13): X is T or S
  MISC_FEATURE (14)..(14): X is I, L or V
  MISC_FEATURE (15)..(15): X is T or S
  MISC_FEATURE (16)..(16): X is N or Q for amidated amino acids
  MISC_FEATURE (17)..(17): X is F or P
  MISC_FEATURE (18)..(18): X is K, R or H for basic amino acids
  MISC_FEATURE (19)..(19): X is F, W or Y for aromatic amino acids
XXXXXXXXXXXXXXXXXXX

SEQ ID NO: 471 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is F or P
  MISC_FEATURE (3)..(3): X is F, W or Y for aromatic amino acids
  MISC_FEATURE (4)..(4): X is I, L or V
  MISC_FEATURE (5)..(5): X is K, R or H for basic amino acids
  MISC_FEATURE (6)..(6): X is N or Q for amidated amino acids
  MISC_FEATURE (7)..(7): X is I, L or V
  MISC_FEATURE (8)..(8): X is N or Q for amidated amino acids
  MISC_FEATURE (9)..(9): X is T or S
  MISC_FEATURE (10)..(10): X is N or Q for amidated amino acids
  MISC_FEATURE (11)..(11): X is D and E for acidic amino acids
  MISC_FEATURE (12)..(12): X is I, L or V
  MISC_FEATURE (13)..(13): X is K, R or H for basic amino acids
  MISC_FEATURE (14)..(14): X is T or S
  MISC_FEATURE (15)..(15): X is I, L or V
  MISC_FEATURE (16)..(16): X is T or S
  MISC_FEATURE (17)..(17): X is N or Q for amidated amino acids
  MISC_FEATURE (18)..(18): X is F or P
  MISC_FEATURE (19)..(19): X is K, R or H for basic amino acids
  MISC_FEATURE (20)..(20): X is F, W or Y for aromatic amino acids
XXXXXXXXXXXXXXXXXXXX

SEQ ID NO: 472 - protein, 18 aa, Artificial
  Completely synthesized peptide construct
  MISC_FEATURE (1)..(1): X is F or P
  MISC_FEATURE (2)..(2): X is F, W or Y for aromatic amino acids
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is I, L or V
  MISC_FEATURE (7)..(7): X is N or Q for amidated amino acids
  MISC_FEATURE (8)..(8): X is T or S
  MISC_FEATURE (9)..(9): X is N or Q for amidated amino acids
  MISC_FEATURE (10)..(10)
  MISC_FEATURE (10)..(10): X is Gaba2 for X2X3 or X3X2 or X2X3 or X3X2 or X3X3 or X2X2
  MISC_FEATURE (11)..(11): X is K, R or H for basic amino acids
  MISC_FEATURE (12)..(12): X is T or S
  MISC_FEATURE (13)..(13): X is T or S
  MISC_FEATURE (14)..(14): X is T or S
  MISC_FEATURE (15)..(15): X is N or Q for amidated amino acids
  MISC_FEATURE (16)..(16): X is F or P
  MISC_FEATURE (17)..(17): X is K, R or H for basic amino acids
  MISC_FEATURE (18)..(18): X is F, W or Y for aromatic amino acids
XXXXXXXXXXXXXXXXXX

SEQ ID NO: 473 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is F or P
  MISC_FEATURE (3)..(3): X is F, W or Y for aromatic amino acids
  MISC_FEATURE (4)..(4): X is I, L or V
  MISC_FEATURE (5)..(5): X is K, R or H for basic amino acids
  MISC_FEATURE (6)..(6): X is N or Q for amidated amino acids
  MISC_FEATURE (7)..(7): X is I, L or V
  MISC_FEATURE (8)..(8): X is N or Q for amidated amino acids
  MISC_FEATURE (9)..(9): X is T or S
  MISC_FEATURE (10)..(10): X is N or Q for amidated amino acids
  MISC_FEATURE (11)..(11): X is GabaX for X2X3 or X3X2 or X2X3 or X3X2 or X3X3 or X2X2
  MISC_FEATURE (12)..(12): X is K, R or H for basic amino acids
  MISC_FEATURE (13)..(13): X is T or S
  MISC_FEATURE (14)..(14): X is I, L or V
  MISC_FEATURE (15)..(15): X is T or S
  MISC_FEATURE (16)..(16): X is N or Q for amidated amino acids
  MISC_FEATURE (17)..(17): X is F or P
  MISC_FEATURE (18)..(18): X is K, R or H for basic amino acids
  MISC_FEATURE (19)..(19): X is F, W or Y for aromatic amino acids
XXXXXXXXXXXXXXXXXXX

SEQ ID NO: 474 - protein, 20 aa, Homo sapiens
DGEAGKPGKAGERGPPGPQG

SEQ ID NO: 475 - protein, 20 aa, Artificial
  Completely synthesized peptide construct
  MISC_FEATURE (1)..(1): X is D and E for acidic amino acids
  MISC_FEATURE (2)..(2): X is A and G
  MISC_FEATURE (3)..(3): X is D and E for acidic amino acids
  MISC_FEATURE (4)..(4): X is A and G
  MISC_FEATURE (5)..(5): X is A and G
  MISC_FEATURE (6)..(6): X is K, R or H for basic amino acids
  MISC_FEATURE (7)..(7): X is F or P
  MISC_FEATURE (8)..(8): X is A and G
  MISC_FEATURE (9)..(9): X is K, R or H for basic amino acids
  MISC_FEATURE (10)..(10): X is A and G
  MISC_FEATURE (11)..(11): X is A and G
  MISC_FEATURE (12)..(12): X is D and E for acidic amino acids
  MISC_FEATURE (13)..(13): X is K, R or H for basic amino acids
  MISC_FEATURE (14)..(14): X is A and G
  MISC_FEATURE (15)..(15): X is F or P
  MISC_FEATURE (16)..(16): X is F or P
  MISC_FEATURE (17)..(17): X is A and G
  MISC_FEATURE (18)..(18): X is F or P
  MISC_FEATURE (19)..(19): X is N or Q for amidated amino acids
  MISC_FEATURE (20)..(20): X is A and G
XXXXXXXXXXXXXXXXXXXX

SEQ ID NO: 476 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is A and G
  MISC_FEATURE (4)..(4): X is D and E for acidic amino acids
  MISC_FEATURE (5)..(5): X is A and G
  MISC_FEATURE (6)..(6): X is A and G
  MISC_FEATURE (7)..(7): X is K, R or H for basic amino acids
  MISC_FEATURE (8)..(8): X is A and G
  MISC_FEATURE (9)..(9): X is K, R or H for basic amino acids
  MISC_FEATURE (10)..(10): X is K, R or H for basic amino acids
  MISC_FEATURE (11)..(11): X is A and G
  MISC_FEATURE (12)..(12): X is A and G
  MISC_FEATURE (13)..(13): X is D and E for acidic amino acids
  MISC_FEATURE (14)..(14): X is K, R or H for basic amino acids
  MISC_FEATURE (15)..(15): X is A and G
  MISC_FEATURE (16)..(16): X is F or P
  MISC_FEATURE (17)..(17): X is F or P
  MISC_FEATURE (18)..(18): X is A and G
  MISC_FEATURE (19)..(19): X is F or P
  MISC_FEATURE (20)..(20): X is N or Q for amidated amino acids
  MISC_FEATURE (21)..(21): X is A and G
XXXXXXXXXXXXXXXXXXXXX

SEQ ID NO: 477 - protein, 20 aa, Homo sapiens
GLDGAKGEAGAPGVKGESGS

SEQ ID NO: 478 - protein, 21 aa, Artificial
  Completely synthesized peptide construct
  MISC_FEATURE (1)..(1): X is A and G
  MISC_FEATURE (2)..(2): X is I, L or V
  MISC_FEATURE (3)..(3): X is D and E for acidic amino acids
  MISC_FEATURE (4)..(4): X is A and G
  MISC_FEATURE (5)..(5): X is A and G
  MISC_FEATURE (6)..(6): X is K, R or H for basic amino acids
  MISC_FEATURE (7)..(7): X is A and G
  MISC_FEATURE (8)..(8): X is D and E for acidic amino acids
  MISC_FEATURE (9)..(9): X is A and G
  MISC_FEATURE (10)..(10): X is A and G
  MISC_FEATURE (11)..(11): X is A and G
  MISC_FEATURE (12)..(12): X is F or P
  MISC_FEATURE (13)..(13): X is A and G
  MISC_FEATURE (14)..(14): X is I, L or V
  MISC_FEATURE (15)..(15): X is K, R or H for basic amino acids
  MISC_FEATURE (16)..(16): X is A and G
  MISC_FEATURE (17)..(17): X is D and E for acidic amino acids
  MISC_FEATURE (18)..(18): X is T or S
  MISC_FEATURE (19)..(19): X is A and G
  MISC_FEATURE (20)..(20): X is A and G
  MISC_FEATURE (21)..(21): X is T or S
XXXXXXXXXXXXXXXXXXXXX

SEQ ID NO: 479 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is I, L or V
  MISC_FEATURE (4)..(4): X is D and E for acidic amino acids
  MISC_FEATURE (5)..(5): X is A and G
  MISC_FEATURE (6)..(6): X is A and G
  MISC_FEATURE (7)..(7): X is K, R or H for basic amino acids
  MISC_FEATURE (8)..(8): X is A and G
  MISC_FEATURE (9)..(9): X is D and E for acidic amino acids
  MISC_FEATURE (10)..(10): X is A and G
  MISC_FEATURE (11)..(11): X is A and G
  MISC_FEATURE (12)..(12): X is A and G
  MISC_FEATURE (13)..(13): X is F or P
  MISC_FEATURE (14)..(14): X is A and G
  MISC_FEATURE (15)..(15): X is I, L or V
  MISC_FEATURE (16)..(16): X is K, R or H for basic amino acids
  MISC_FEATURE (17)..(17): X is A and G
  MISC_FEATURE (18)..(18): X is D and E for acidic amino acids
  MISC_FEATURE (19)..(19): X is T or S
  MISC_FEATURE (20)..(20): X is A and G
  MISC_FEATURE (21)..(21): X is T or S
XXXXXXXXXXXXXXXXXXXXX

SEQ ID NO: 480 - protein, 19 aa, Artificial
  Completely synthesized peptide construct
  MISC_FEATURE (1)..(1): X is A and G
  MISC_FEATURE (2)..(2): X is GabaX for X2X3 or X3X2 or X2X3 or X3X2 or X3X3 or X2X2
  MISC_FEATURE (3)..(3): X is A and G
  MISC_FEATURE (4)..(4): X is A and G
  MISC_FEATURE (5)..(5): X is K, R or H for basic amino acids
  MISC_FEATURE (6)..(6): X is A and G
  MISC_FEATURE (7)..(7): X is D and E for acidic amino acids
  MISC_FEATURE (8)..(8): X is A and G
  MISC_FEATURE (9)..(9): X is A and G
  MISC_FEATURE (10)..(10): X is A and G
  MISC_FEATURE (11)..(11): X is F or P
  MISC_FEATURE (12)..(12): X is A and G
  MISC_FEATURE (13)..(13): X is I, L or V
  MISC_FEATURE (14)..(14): X is K, R or H for basic amino acids
  MISC_FEATURE (15)..(15): X is A and G
  MISC_FEATURE (16)..(16): X is D and E for acidic amino acids
  MISC_FEATURE (17)..(17): X is T or S
  MISC_FEATURE (18)..(18): X is A and G
  MISC_FEATURE (19)..(19): X is T or S
XXXXXXXXXXXXXXXXXXX

SEQ ID NO: 481 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is GabaX for X2X3 or X3X2 or X2X3 or X3X2 or X3X3 or X2X2
  MISC_FEATURE (4)..(4): X is A and G
  MISC_FEATURE (5)..(5): X is A and G
  MISC_FEATURE (6)..(6): X is K, R or H for basic amino acids
  MISC_FEATURE (7)..(7): X is A and G
  MISC_FEATURE (8)..(8): X is D and E for acidic amino acids
  MISC_FEATURE (9)..(9): X is A and G
  MISC_FEATURE (10)..(10): X is A and G
  MISC_FEATURE (11)..(11): X is A and G
  MISC_FEATURE (12)..(12): X is F or P
  MISC_FEATURE (13)..(13): X is A and G
  MISC_FEATURE (14)..(14): X is I, L or V
  MISC_FEATURE (15)..(15): X is K, R or H for basic amino acids
  MISC_FEATURE (16)..(16): X is A and G
  MISC_FEATURE (17)..(17): X is D and E for acidic amino acids
  MISC_FEATURE (18)..(18): X is T or S
  MISC_FEATURE (19)..(19): X is A and G
  MISC_FEATURE (20)..(20): X is T or S
XXXXXXXXXXXXXXXXXXXX

SEQ ID NO: 482 - protein, 20 aa, Homo sapiens
ERGAAGIAGDKGDRGDVGEK

SEQ ID NO: 483 - protein, 20 aa, Artificial
  Completely synthesized peptide construct
  MISC_FEATURE (1)..(1): X is D and E for acidic amino acids
  MISC_FEATURE (2)..(2): X is K, R or H for basic amino acids
  MISC_FEATURE (3)..(3): X is A and G
  MISC_FEATURE (4)..(4): X is A and G
  MISC_FEATURE (5)..(5): X is A and G
  MISC_FEATURE (6)..(6): X is A and G
  MISC_FEATURE (7)..(7): X is I, L or V
  MISC_FEATURE (8)..(8): X is A and G
  MISC_FEATURE (9)..(9): X is A and G
  MISC_FEATURE (10)..(10): X is D and E for acidic amino acids
  MISC_FEATURE (11)..(11): X is K, R or H for basic amino acids
  MISC_FEATURE (12)..(12): X is A and G
  MISC_FEATURE (13)..(13): X is D and E for acidic amino acids
  MISC_FEATURE (14)..(14): A is K, R or H for basic amino acids
  MISC_FEATURE (15)..(15): X is A and G
  MISC_FEATURE (16)..(16): X is D and E for acidic amino acids
  MISC_FEATURE (17)..(17): X is I, L or V
  MISC_FEATURE (18)..(18): X is A and G
  MISC_FEATURE (19)..(19): X is D and E for acidic amino acids
  MISC_FEATURE (20)..(20): X is K, R or H for basic amino acids
XXXXXXXXXXXXXXXXXXXX

SEQ ID NO: 484 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is K, R or H for basic amino acids
  MISC_FEATURE (4)..(4): X is A and G
  MISC_FEATURE (5)..(5): X is A and G
  MISC_FEATURE (6)..(6): X is A and G
  MISC_FEATURE (7)..(7): X is A and G
  MISC_FEATURE (8)..(8): X is I, L or V
  MISC_FEATURE (9)..(9): X is A and G
  MISC_FEATURE (10)..(10): X is A and G
  MISC_FEATURE (11)..(11): X is D and E for acidic amino acids
  MISC_FEATURE (12)..(12): X is K, R or H for basic amino acids
  MISC_FEATURE (13)..(13): X is D and E for acidic amino acids
  MISC_FEATURE (14)..(14): X is K, R or H for basic amino acids
  MISC_FEATURE (15)..(15): X is A and G
  MISC_FEATURE (16)..(16): X is D and E for acidic amino acids
  MISC_FEATURE (17)..(17): X is I, L or V
  MISC_FEATURE (18)..(18): X is A and G
  MISC_FEATURE (19)..(19): X is A and G
  MISC_FEATURE (20)..(20): X is D and E for acidic amino acids
  MISC_FEATURE (21)..(21): X is K, R or H for basic amino acids
XXXXXXXXXXXXXXXXXXXXX

SEQ ID NO: 485 - protein, 19 aa, Artificial
  Completely synthesized peptide construct
  MISC_FEATURE (1)..(1): X is D and E for acidic amino acids
  MISC_FEATURE (2)..(2): X is K, R or H for basic amino acids
  MISC_FEATURE (3)..(3): X is A and G
  MISC_FEATURE (4)..(4): X is A and G
  MISC_FEATURE (5)..(5): X is A and G
  MISC_FEATURE (6)..(6): X is A and G
  MISC_FEATURE (7)..(7): X is I, L or V
  MISC_FEATURE (8)..(8): X is A and G
  MISC_FEATURE (9)..(9): X is A and G
  MISC_FEATURE (10)..(10): X is D and E for acidic amino acids
  MISC_FEATURE (11)..(11): X is K, R or H for basic amino acids
  MISC_FEATURE (12)..(12): X is A and G
  MISC_FEATURE (13)..(13): X is D and E for acidic amino acids
  MISC_FEATURE (14)..(14): X is K. R or H for basic amino acids
  MISC_FEATURE (15)..(15): X is A and G
  MISC_FEATURE (16)..(16): X is GabaX for X2X3 or X3X2 or X2X3 or X3X2 or X3X3 or X2X2
  MISC_FEATURE (17)..(17): X is A and G
  MISC_FEATURE (18)..(18): X is D and E for acidic amino acids
  MISC_FEATURE (19)..(19): X is K, R or H for basic amino acids
XXXXXXXXXXXXXXXXXXX

SEQ ID NO: 486 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is K, R or H for basic amino acids
  MISC_FEATURE (4)..(4): X is A and G
  MISC_FEATURE (5)..(5): X is A and G
  MISC_FEATURE (6)..(6): X is A and G
  MISC_FEATURE (7)..(7): X is A and G
  MISC_FEATURE (8)..(8): X is I, L or V
  MISC_FEATURE (9)..(9): X is A and G
  MISC_FEATURE (10)..(10): X is A and G
  MISC_FEATURE (11)..(11): X is D and E for acidic amino acids
  MISC_FEATURE (12)..(12): X is K, R or H for basic amino acids
  MISC_FEATURE (13)..(13): X is A and G
  MISC_FEATURE (14)..(14): X is D and E for acidic amino acids
  MISC_FEATURE (15)..(15): X is K, R or H for basic amino acids
  MISC_FEATURE (16)..(16): X is A and G
  MISC_FEATURE (17)..(17): X is GabaX for X2X3 or X3X2 or X2X3 or X3X2 or X3X3 or X2X2
  MISC_FEATURE (18)..(18): X is A and G
  MISC_FEATURE (19)..(19): X is D and E for acidic amino acids
  MISC_FEATURE (20)..(20): X is K, R or H for basic amino acids
XXXXXXXXXXXXXXXXXXXX

SEQ ID NO: 487 - protein, 17 aa, Homo sapiens
DGRGDSLAYGLRSKSKK

SEQ ID NO: 488 - protein, 7 aa, Artificial
  Completely synthesized peptide construct
  MISC_FEATURE (1)..(1): X is T or S
  MISC_FEATURE (2)..(2): X is I, L or V
  MISC_FEATURE (3)..(3): X is A and G
  MISC_FEATURE (4)..(4): X is F, W or Y for aromatic amino acids
  MISC_FEATURE (5)..(5): X is A and G
  MISC_FEATURE (6)..(6): X is I, L or V
  MISC_FEATURE (7)..(7): X is K, R or H for basic amino acids
XXXXXXX

SEQ ID NO: 489 - protein, 8 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is I, L or V
  MISC_FEATURE (4)..(4): X is A and G
  MISC_FEATURE (5)..(5): X is F, W or Y for aromatic amino acids
  MISC_FEATURE (6)..(6): X is A and G
  MISC_FEATURE (7)..(7): X is I, L or V
  MISC_FEATURE (8)..(8): X is K, R or H for basic amino acids
XXXXXXXX

SEQ ID NO: 490 - protein, 15 aa, Homo sapiens
QKRAAYKQYGHAAFE

SEQ ID NO: 491 - protein, 15 aa, Artificial
  Completely synthesized peptide construct
  MISC_FEATURE (1)..(1): X is N or Q for amidated amino acids
  MISC_FEATURE (2)..(2): X is K, R or H for basic amino acids
  MISC_FEATURE (3)..(3): X is K, R or H for basic amino acids
  MISC_FEATURE (4)..(4): X is A and G
  MISC_FEATURE (5)..(5): X is A and G
  MISC_FEATURE (6)..(6): X is F, W or Y for aromatic amino acids
  MISC_FEATURE (7)..(7): X is K, R or H for basic amino acids
  MISC_FEATURE (8)..(8): X is N or Q for amidated amino acids
  MISC_FEATURE (9)..(9): X is F, W or Y for aromatic amino acids
  MISC_FEATURE (10)..(10): X is A and G
  MISC_FEATURE (11)..(11): X is K, R or H for basic amino acids
  MISC_FEATURE (12)..(12): X is A and G
  MISC_FEATURE (13)..(13): X is A and G
  MISC_FEATURE (14)..(14): X is F or P
  MISC_FEATURE (15)..(15): X is D and E for acidic amino acids
XXXXXXXXXXXXXXX

SEQ ID NO: 492 - protein, 16 aa, Artificial
  Completely synthesized peptide construct
  MISC_FEATURE (1)..(1): X is aceytl or propionyl group, D glycine or D alanine, cyclohexylalanine at amino terminus
  MISC_FEATURE (2)..(2): X is N or Q for amidated amino acids
  MISC_FEATURE (3)..(3): X is K, R or H for basic amino acids
  MISC_FEATURE (4)..(4): X is K, R or H for basic amino acids
  MISC_FEATURE (5)..(5): X A and G
  MISC_FEATURE (6)..(6): X A and G
  MISC_FEATURE (7)..(7): X is F, W or Y for aromatic amino acids
  MISC_FEATURE (8)..(8): X is K, R or H for basic amino acids
  MISC_FEATURE (9)..(9): X is N or Q for amidated amino acids
  MISC_FEATURE (10)..(10): X is F, W or Y for aromatic amino acids
  MISC_FEATURE (11)..(11): X is A and G
  MISC_FEATURE (12)..(12): X is K, R or H for basic amino acids
  MISC_FEATURE (13)..(13): X is A and G
  MISC_FEATURE (14)..(14): X is A and G
  MISC_FEATURE (15)..(15): X is F or P
  MISC_FEATURE (16)..(16): X is D and E for acidic amino acids
XXXXXXXXXXXXXXXX

SEQ ID NO: 493 - protein, 14 aa, Homo sapiens
ERAAYDQYGHAAFE

SEQ ID NO: 494 - protein, 14 aa, Artificial
  Completely synthesized peptide construct
  MISC_FEATURE (1)..(1): X is D and E for acidic amino acids
  MISC_FEATURE (2)..(2): X is K, R or H for basic amino acids
  MISC_FEATURE (3)..(3): X is A and G
  MISC_FEATURE (4)..(4): X is A and G
  MISC_FEATURE (5)..(5): X is F, W or Y for aromatic amino acids
  MISC_FEATURE (6)..(6): X is D and E for acidic amino acids
  MISC_FEATURE (7)..(7): X is N or Q for amidated amino acids
  MISC_FEATURE (8)..(8): X is F, W or Y for aromatic amino acids
  MISC_FEATURE (9)..(9): X is A and G
  MISC_FEATURE (10)..(10): X is K, R or H for basic amino acids
  MISC_FEATURE (11)..(11): X is A and G
  MISC_FEATURE (12)..(12): X is A and G
  MISC_FEATURE (13)..(13): X is F or P
  MISC_FEATURE (14)..(14): X is D and E for acidic amino acids
XXXXXXXXXXXXXX

SEQ ID NO: 495 - protein, 15 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is K, R or H for basic amino acids
  MISC_FEATURE (4)..(4): X is A and G
  MISC_FEATURE (5)..(5): X is A and G
  MISC_FEATURE (6)..(6): X is F, W or Y for aromatic amino acids
  MISC_FEATURE (7)..(7): X is D and E for acidic amino acids
  MISC_FEATURE (8)..(8): X is N or Q for amidated amino acids
  MISC_FEATURE (9)..(9): X is F, W or Y for aromatic amino acids
  MISC_FEATURE (10)..(10): X is A and G
  MISC_FEATURE (11)..(11): X is K, R or H for basic amino acids
  MISC_FEATURE (12)..(12): X is A and G
  MISC_FEATURE (13)..(13): X is A and G
  MISC_FEATURE (14)..(14): X is F or P
  MISC_FEATURE (15)..(15): X is A and G
XXXXXXXXXXXXXXX

SEQ ID NO: 496 - protein, 17 aa, Homo sapiens
SVKLSIAVKNKAEFHQS

SEQ ID NO: 497 - protein, 17 aa, Artificial
  Completely synthesized peptide construct
  MISC_FEATURE (1)..(1): X is T or S
  MISC_FEATURE (2)..(2): X is I, L or V
  MISC_FEATURE (3)..(3): X is K, R or H for basic amino acids
  MISC_FEATURE (4)..(4): X is I, L or V
  MISC_FEATURE (5)..(5): X is T or S
  MISC_FEATURE (6)..(6): X is I, L or V
  MISC_FEATURE (7)..(7): X is A and G
  MISC_FEATURE (8)..(8): X is I, L or V
  MISC_FEATURE (9)..(9): X is K, R or H for basic amino acids
  MISC_FEATURE (10)..(10): X is N or Q for amidated amino acids
  MISC_FEATURE (11)..(11): X is K, R or H for basic amino acids
  MISC_FEATURE (12)..(12): X is A and G
  MISC_FEATURE (13)..(13): X is D and E for acidic amino acids
  MISC_FEATURE (14)..(14): X is F or P
  MISC_FEATURE (15)..(15): X is K, R or H for basic amino acids
  MISC_FEATURE (16)..(16): X is N or Q for amidated amino acids
  MISC_FEATURE (17)..(17): X is T or S
XXXXXXXXXXXXXXXXX

SEQ ID NO: 498 - protein, 18 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is I, L or V
  MISC_FEATURE (4)..(4): X is K, R or H for basic amino acids
  MISC_FEATURE (5)..(5): X is I, L or V
  MISC_FEATURE (6)..(6): X is T or S
  MISC_FEATURE (7)..(7): X is I, L or V
  MISC_FEATURE (8)..(8): X is A and G
  MISC_FEATURE (9)..(9): X is I, L or V
  MISC_FEATURE (10)..(10): X is K, R or H for basic amino acids
  MISC_FEATURE (11)..(11): X is N or Q for amidated amino acids
  MISC_FEATURE (12)..(12): X is K, R or H for basic amino acids
  MISC_FEATURE (13)..(13): X is A and G
  MISC_FEATURE (14)..(14): X is D and E for acidic amino acids
  MISC_FEATURE (15)..(15): X is F or P
  MISC_FEATURE (16)..(16): X is K, R or H for basic amino acids
  MISC_FEATURE (17)..(17): X is N or Q for amidated amino acids
  MISC_FEATURE (18)..(18): X is T or S
XXXXXXXXXXXXXXXXXX

SEQ ID NO: 499 - protein, 17 aa, Homo sapiens
NVREGIAFRPASKTFTV

SEQ ID NO: 500 - protein, 17 aa, Artificial
  Completely synthesized peptide construct
  MISC_FEATURE (1)..(1): X is N or Q for amidated amino acids
  MISC_FEATURE (2)..(2): X is I, L or V
  MISC_FEATURE (3)..(3): X is K, R or H for basic amino acids
  MISC_FEATURE (4)..(4): X is D and E for acidic amino acids
  MISC_FEATURE (5)..(5): X is A and G
  MISC_FEATURE (6)..(5): X is I, L or V
  misc_feature (6)..(6): Xaa can be any naturally occurring amino acid
  MISC_FEATURE (7)..(7): X is A and G
  MISC_FEATURE (8)..(8): X is F or P
  MISC_FEATURE (9)..(9): X is K, R or H for basic amino acids
  MISC_FEATURE (10)..(10): X is F or P
  MISC_FEATURE (11)..(11): X is A and G
  MISC_FEATURE (12)..(12): X is T or S
  MISC_FEATURE (13)..(13): X is K, R or H for basic amino acids
  MISC_FEATURE (14)..(14): X is T or S
  MISC_FEATURE (15)..(15): X is F or P
  MISC_FEATURE (16)..(16): X is T or S
  MISC_FEATURE (17)..(17): X is I, L or V
XXXXXXXXXXXXXXXXX

SEQ ID NO: 501 - protein, 18 aa, Artificial
  Completely synthesized peptide construct
  MISC_FEATURE (1)..(1): X is aceytl or propionyl group, D glycine or D alanine, cyclohexylalanine at amino terminus
  MISC_FEATURE (2)..(2): X is N or Q for amidated amino acids
  MISC_FEATURE (3)..(3): X is I, L or V
  MISC_FEATURE (4)..(4): X is K, R or H for basic amino acids
  MISC_FEATURE (5)..(5): X is D and E for acidic amino acids
  MISC_FEATURE (6)..(6): X is A and G
  MISC_FEATURE (7)..(7): X is I, L or V
  MISC_FEATURE (8)..(8): X is A and G
  MISC_FEATURE (9)..(9): X is F or P
  MISC_FEATURE (10)..(10): X is K, R or H for basic amino acids
  MISC_FEATURE (11)..(11): X is F or P
  MISC_FEATURE (12)..(12): X is A and G
  MISC_FEATURE (13)..(13): X is T or S
  MISC_FEATURE (14)..(14): X is K, R or H for basic amino acids
  MISC_FEATURE (15)..(15): X is T or S
  MISC_FEATURE (16)..(16): X is F or P
  MISC_FEATURE (17)..(17): X is T or S
  MISC_FEATURE (18)..(18): X is I, L or V
XXXXXXXXXXXXXXXXXX

SEQ ID NO: 502 - protein, 14 aa, Artificial
  Completely synthesized peptide construct
  misc_feature (2)..(2): Xaa can be any naturally occurring amino acid
  misc_feature (9)..(9): Xaa can be any naturally occurring amino acid
EXIKFAAAXREGED

SEQ ID NO: 503 - protein, 14 aa, Artificial
  Completely synthesized peptide construct
  MISC_FEATURE (1)..(1): X is D and E for acidic amino acids
  MISC_FEATURE (2)..(2): X is A and G; D and E for acidic amino acids; I, L or V; K, R or H for basic amino acids; C or S; F, W or Y for aromatic amino acids; F or P; M or Nle (Norleucine); N or Q for amidated amino acids; and T or S
  MISC_FEATURE (3)..(3): X is I, L or V
  MISC_FEATURE (4)..(4): X is K, R or H for basic amino acids
  MISC_FEATURE (5)..(5): X is F or P
  MISC_FEATURE (6)..(6): X is A and G
  MISC_FEATURE (7)..(7): X is A and G
  MISC_FEATURE (8)..(8): X is A and G
  MISC_FEATURE (9)..(9): X is
  MISC_FEATURE (10)..(10): X is K, R or H for basic amino acids
  MISC_FEATURE (11)..(11): X is D and E for acidic amino acids
  MISC_FEATURE (12)..(12): X is A and G
  MISC_FEATURE (13)..(13): X is D and E for acidic amino acids
  MISC_FEATURE (14)..(14): X is D and E for acidic amino acids
XXXXXXXXXXXXXX

SEQ ID NO: 504 - protein, 15 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is A and G; D and E for acidic amino acids; I, L or V; K, R or H for basic amino acids; C or S; F, W or Y for aromatic amino acids; F or P; M or Nle (Norleucine); N or Q for amidated amino acids; and T or S
  MISC_FEATURE (4)..(4): X is I, L or V
  MISC_FEATURE (5)..(5): X is K, R or H for basic amino acids
  MISC_FEATURE (6)..(6): X is F or P
  MISC_FEATURE (7)..(7): X is A and G
  MISC_FEATURE (8)..(8): X is A and G
  MISC_FEATURE (9)..(9): X is A and G
  MISC_FEATURE (10)..(10): X is
  MISC_FEATURE (11)..(11): X is K, R or H for basic amino acids
  MISC_FEATURE (12)..(12): X is A and G
  MISC_FEATURE (13)..(13): X is A and G
  MISC_FEATURE (14)..(14): X is D and E for acidic amino acids
  MISC_FEATURE (15)..(15): X is D and E for acidic amino acids
XXXXXXXXXXXXXXX

SEQ ID NO: 505 - protein, 12 aa, Artificial
  Completely synthesized peptide construct
  MISC_FEATURE (1)..(1): X is GabaX for X2X3 or X3X2 or X2X3 or X3X2 or X3X3 or X2X2
  MISC_FEATURE (2)..(2): X is K, R or H for basic amino acids
  MISC_FEATURE (3)..(3): X is F or P
  MISC_FEATURE (4)..(4): X is A and G
  MISC_FEATURE (5)..(5): X is A and G
  MISC_FEATURE (6)..(6): X is A and G
  MISC_FEATURE (7)..(6): X is A and G; D and E for acidic amino acids; I, L or V; K, R or H for basic amino acids; C or S; F, W or Y for aromatic amino acids; F or P; M or Nle (Norleucine); N or Q for amidated amino acids; and T or S
  misc_feature (7)..(7): Xaa can be any naturally occurring amino acid
  MISC_FEATURE (8)..(8): X is K, R or H for basic amino acids
  MISC_FEATURE (9)..(9): X is D and E for acidic amino acids
  MISC_FEATURE (10)..(10): X is A and G
  MISC_FEATURE (11)..(11): X is D and E for acidic amino acids
  MISC_FEATURE (12)..(12): X is D and E for acidic amino acids
XXXXXXXXXXXX

SEQ ID NO: 506 - protein, 12 aa, Artificial
  Completely synthesized peptide construct
  MISC_FEATURE (1)..(1): X is 5-aminopentanoic acid for replacement of 3 or 4 amino acids of X2 and X3
  MISC_FEATURE (2)..(2): X is K, R or H for basic amino acids
  MISC_FEATURE (3)..(3): X is F or P
  MISC_FEATURE (4)..(4): X is A and G
  MISC_FEATURE (5)..(5): X is A and G
  MISC_FEATURE (6)..(6): X is A and G
  MISC_FEATURE (7)..(6): X is A and G; D and E for acidic amino acids; I, L or V; K, R or H for basic amino acids; C or S; F, W or Y for aromatic amino acids; F or P; M or Nle (Norleucine); N or Q for amidated amino acids; and T or S
  misc_feature (7)..(7): Xaa can be any naturally occurring amino acid
  MISC_FEATURE (8)..(8): X is K, R or H for basic amino acids
  MISC_FEATURE (9)..(9): X is D and E for acidic amino acids
  MISC_FEATURE (9)..(9): X is D and E for acidic amino acids
  MISC_FEATURE (10)..(10): X is A and G
  MISC_FEATURE (11)..(11): X is D and E for acidic amino acids
  MISC_FEATURE (12)..(12): X is D and E for acidic amino acids
XXXXXXXXXXXX

SEQ ID NO: 507 - protein, 11 aa, Artificial
  Completely synthesized peptide construct
  MISC_FEATURE (1)..(1): X is Gaba2 for X2X3 or X3X2 or X2X3 or X3X2 or X3X3 or X2X2
  MISC_FEATURE (2)..(2): X is K, R or H for basic amino acids
  MISC_FEATURE (3)..(3): X is F or P
  MISC_FEATURE (4)..(4): X is A and G
  MISC_FEATURE (5)..(5): X is A and G
  MISC_FEATURE (6)..(6): X is A and G
  MISC_FEATURE (7)..(7): X is A and G; D and E for acidic amino acids; I, L or V; K, R or H for basic amino acids; C or S; F, W or Y for aromatic amino acids; F or P; M or Nle (Norleucine); N or Q for amidated amino acids; and T or S
  MISC_FEATURE (8)..(8): X is K, R or H for basic amino acids
  MISC_FEATURE (9)..(9): X is D and E for acidic amino acids
  MISC_FEATURE (10)..(10): X is A and G
  MISC_FEATURE (11)..(11): GabaX for X2X3 or X3X2 or X2X3 or X3X2 or X3X3 or X2X2
XXXXXXXXXXX

SEQ ID NO: 508 - protein, 11 aa, Artificial
  Completely synthesized peptide construct
  MISC_FEATURE (1)..(1): X is 5-aminopentanoic acid for replacement fo 3 or 4 amino acids of X2 and X3
  MISC_FEATURE (2)..(2): X is K, R or H for basic amino acids
  MISC_FEATURE (3)..(3): X is F or P
  MISC_FEATURE (4)..(4): X is A and G
  MISC_FEATURE (5)..(5): X is A and G
  MISC_FEATURE (6)..(6): X is A and G
  MISC_FEATURE (7)..(6): X is A and G; D and E for acidic amino acids; I, L or V; K, R or H for basic amino acids; C or S; F, W or Y for aromatic amino acids; F or P; M or Nle (Norleucine); N or Q for amidated amino acids; and T or S
  misc_feature (7)..(7): Xaa can be any naturally occurring amino acid
  MISC_FEATURE (8)..(8): X is K, R or H for basic amino acids
  MISC_FEATURE (9)..(9): X is D and E for acidic amino acids
  MISC_FEATURE (10)..(10): X is A and G
  MISC_FEATURE (11)..(11): X is Gaba2 for X2X3 or X3X2 or X2X3 or X3X2 or X3X3 or X2X2
XXXXXXXXXXX

SEQ ID NO: 509 - protein, 13 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is GabaX for X2X3 or X3X2 or X2X3 or X3X2 or X3X3 or X2X2
  MISC_FEATURE (3)..(3): X is K, R or H for basic amino acids
  MISC_FEATURE (4)..(4): X is F or P
  MISC_FEATURE (5)..(5): X is A and G
  MISC_FEATURE (6)..(6): X is A and G
  MISC_FEATURE (7)..(7): X is A and G
  MISC_FEATURE (8)..(8): X is
  MISC_FEATURE (9)..(9): X is K, R or H for basic amino acids
  MISC_FEATURE (10)..(10): X is D and E for acidic amino acids
  MISC_FEATURE (11)..(11): X is A and G
  MISC_FEATURE (12)..(12): X is D and E for acidic amino acids
  MISC_FEATURE (13)..(13): X is D and E for acidic amino acids
XXXXXXXXXXXXX

SEQ ID NO: 510 - protein, 13 aa, Artificial
  Completely synthesized peptide construct
  MISC_FEATURE (1)..(1): X is acetyl or propionyl group, D glycine or D alanine, cyclohexylalanie at amino terminus
  MISC_FEATURE (2)..(2): X is 5-aminipentanoic acid for replacement of 3 or 4 amino acids of X2 and X3
  MISC_FEATURE (3)..(3): X is K, R or H for basic amino acids
  MISC_FEATURE (4)..(4): X is F or P
  MISC_FEATURE (5)..(5): X is A and G
  MISC_FEATURE (6)..(6): X is A and G
  MISC_FEATURE (7)..(7): X is A and G
  MISC_FEATURE (8)..(8): X is
  MISC_FEATURE (9)..(9): X is K, R or H for basic amino acids
  MISC_FEATURE (10)..(10): X is D and E for acidic amino acids
  MISC_FEATURE (11)..(11): X is A and G
  MISC_FEATURE (12)..(12): X is D and E for acidic amino acids
  MISC_FEATURE (13)..(13): X is D and E for acidic amino acids
XXXXXXXXXXXXX

SEQ ID NO: 511 - protein, 12 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is GabaX for X2X3 or X3X2 or X2X3 or X3X2 or X3X3 or X2X2
  MISC_FEATURE (3)..(3): X is K, R or H for basic amino acids
  MISC_FEATURE (4)..(4): X is F or P
  MISC_FEATURE (5)..(5): X is A and G
  MISC_FEATURE (6)..(6): X is A and G
  MISC_FEATURE (7)..(7): X is A and G
  MISC_FEATURE (8)..(8): X is
  MISC_FEATURE (9)..(9): X is K, R or H for basic amino acids
  MISC_FEATURE (10)..(10): X is D and E for acidic amino acids
  MISC_FEATURE (11)..(11): X is A and G
  MISC_FEATURE (12)..(12): X is GabaX for X2X3 or X3X2 or X2X3 or X3X2 or X3X3 or X2X2
XXXXXXXXXXXX

SEQ ID NO: 512 - protein, 12 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is 5-aminopentanoic acid for replacement of 3 or 4 amino acids of X2 and X3
  MISC_FEATURE (3)..(3): X is K, R or H for basic amino acids
  MISC_FEATURE (4)..(4): X is F or P
  MISC_FEATURE (5)..(5): X is A and G
  MISC_FEATURE (6)..(6): X is A and G
  MISC_FEATURE (7)..(7): X is A and G
  MISC_FEATURE (8)..(8): X is
  MISC_FEATURE (9)..(9): X is K, R or H for basic amino acids
  MISC_FEATURE (10)..(10): X is D and E for acidic amino acids
  MISC_FEATURE (11)..(11): X is A and G
  MISC_FEATURE (12)..(12): X is GabaX for X2X3 or X3X2 or X2X3 or X3X2 or X3X3 or X2X2
XXXXXXXXXXXX

SEQ ID NO: 513 - protein, 13 aa, Artificial
  Completely synthesized peptide construct
PVVHFFKNIVTPR

SEQ ID NO: 514 - protein, 13 aa, Artificial
  Completely synthesized peptide construct
  MISC_FEATURE (1)..(1): X is F or P
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is F or P
  MISC_FEATURE (6)..(6): X is F or P
  MISC_FEATURE (7)..(7): X is K, R or H for basic amino acids
  MISC_FEATURE (8)..(8): X is N or Q for amidated amino acids
  MISC_FEATURE (9)..(9): X is I, L or V
  MISC_FEATURE (10)..(10): X is I, L or V
  MISC_FEATURE (11)..(11): X is T or S
  MISC_FEATURE (12)..(12): X is F or P
  MISC_FEATURE (13)..(13): X is K, R or H for basic amino acids
XXXXXXXXXXXXX

SEQ ID NO: 515 - protein, 14 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is F or P
  MISC_FEATURE (3)..(3): X is I, L or V
  MISC_FEATURE (4)..(4): X is I, L or V
  MISC_FEATURE (5)..(5): X is K, R or H for basic amino acids
  MISC_FEATURE (6)..(6): X is F or P
  MISC_FEATURE (7)..(7): X is F or P
  MISC_FEATURE (8)..(8): X is K, R or H for basic amino acids
  MISC_FEATURE (9)..(9): X is N or Q for amidated amino acids
  MISC_FEATURE (10)..(10): X is I, L or V
  MISC_FEATURE (11)..(11): X is I, L or V
  MISC_FEATURE (12)..(12): X is T or S
  MISC_FEATURE (13)..(13): X is F or P
  MISC_FEATURE (14)..(14): X is K, R or H for basic amino acids
XXXXXXXXXXXXXX

SEQ ID NO: 516 - protein, 12 aa, Artificial
  Completely synthesized peptide construct
  MISC_FEATURE (1)..(1): X is F or P
  MISC_FEATURE (2)..(2): X is GabaX for X2X3 or X3X2 or X2X3 or X3X2 or X3X3 or X2X2
  MISC_FEATURE (3)..(3): X is K, R or H for basic amino acids
  MISC_FEATURE (4)..(4): X is F or P
  MISC_FEATURE (5)..(5): X is F or P
  MISC_FEATURE (6)..(6): X is K, R or H for basic amino acids
  MISC_FEATURE (7)..(7): X is N or Q for amidated amino acids
  MISC_FEATURE (8)..(8): X is I, L or V
  MISC_FEATURE (9)..(9): X is I, L or V
  MISC_FEATURE (10)..(10): X is T or S
  MISC_FEATURE (11)..(11): X is F or P
  MISC_FEATURE (12)..(12): X is K, R or H for basic amino acids
XXXXXXXXXXXX

SEQ ID NO: 517 - protein, 13 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is F or P
  MISC_FEATURE (3)..(3): X is GabaX for X2X3 or X3X2 or X2X3 or X3X2 or X3X3 or X2X2
  MISC_FEATURE (4)..(4): X is K, R or H for basic amino acids
  MISC_FEATURE (5)..(5): X is F or P
  MISC_FEATURE (6)..(6): X is F or P
  MISC_FEATURE (7)..(7): X is K, R or H for basic amino acids
  MISC_FEATURE (8)..(8): X is N or Q for amidated amino acids
  MISC_FEATURE (9)..(9): X is I, L or V
  MISC_FEATURE (10)..(10): X is I, L or V
  MISC_FEATURE (11)..(11): X is T or S
  MISC_FEATURE (12)..(12): X is F or P
  MISC_FEATURE (13)..(13): X is K, R or H for basic amino acids
XXXXXXXXXXXXX

SEQ ID NO: 518 - protein, 12 aa, Artificial
  Completely synthesized peptide construct
  MISC_FEATURE (1)..(1): X is F or P
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is F or P
  MISC_FEATURE (6)..(6): X is F or P
  MISC_FEATURE (7)..(7): X is K, R or H for basic amino acids
  MISC_FEATURE (8)..(8): X is N or Q for amidated amino acids
  MISC_FEATURE (9)..(9): X is GabaX for X2X3 or X3X2 or X2X3 or X3X2 or X3X3 or X2X2
  MISC_FEATURE (10)..(10): X is T or S
  MISC_FEATURE (11)..(11): X is F or P
  MISC_FEATURE (12)..(12): X is K, R or H for basic amino acids
XXXXXXXXXXXX

SEQ ID NO: 519 - protein, 13 aa, Artificial
  Completely synthesized peptide construct
  MISC_FEATURE (1)..(1): X is acetyl or propionyl group, D glycine or D alanine, cyclohexylalanie at amino terminus
  MISC_FEATURE (2)..(2): X is F or P
  MISC_FEATURE (3)..(3): X is I, L or V
  MISC_FEATURE (4)..(4): X is I, L or V
  MISC_FEATURE (5)..(5): X is K, R or H for basic amino acids
  MISC_FEATURE (6)..(6): X is F or P
  MISC_FEATURE (7)..(7): X is F or P
  MISC_FEATURE (8)..(8): X is K, R or H for basic amino acids
  MISC_FEATURE (9)..(9): X is N or Q for amidated amino acids
  MISC_FEATURE (10)..(10): X is GabaX for X2X3 or X3X2 or X2X3 or X3X2 or X3X3 or X2X2
  MISC_FEATURE (11)..(11): X is T or S
  MISC_FEATURE (12)..(12): X is F or P
  MISC_FEATURE (13)..(13): X is K, R or H for basic amino acids
XXXXXXXXXXXXX

SEQ ID NO: 520 - protein, 13 aa, Artificial
  Completely synthesized peptide construct
  MISC_FEATURE (1)..(1): X is F or P
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is F or P
  MISC_FEATURE (6)..(6): X is F or P
  MISC_FEATURE (7)..(7): X is N or Q for amidated amino acids
  MISC_FEATURE (8)..(8): X is I, L or V
  MISC_FEATURE (9)..(9): X is I, L or V
  MISC_FEATURE (10)..(10): X is T or S
  MISC_FEATURE (11)..(11): X is T or S
  MISC_FEATURE (12)..(12): X is F or P
  MISC_FEATURE (13)..(13): X is K, R or H for basic amino acids
XXXXXXXXXXXXX

SEQ ID NO: 521 - protein, 14 aa, Artificial
  Completely synthesized peptide construct
  MISC_FEATURE (1)..(1): X is acetyl or propionyl group, D glycine or D alanine, cyclodexylalanine at amino terminus
  MISC_FEATURE (2)..(2): X is F or P
  MISC_FEATURE (3)..(3): X is I, L or V
  MISC_FEATURE (4)..(4): X is I, L or V
  MISC_FEATURE (5)..(5): X is K, R or H for basic amino acids
  MISC_FEATURE (6)..(6): X is F or P
  MISC_FEATURE (7)..(7): X is F or P
  MISC_FEATURE (8)..(8): X is K, R or H for basic amino acids
  MISC_FEATURE (9)..(9): X is N or Q for amidated amino acids
  MISC_FEATURE (10)..(10): X is I, L or V
  MISC_FEATURE (11)..(11): X is I, L or V
  MISC_FEATURE (12)..(12): X is T or S
  MISC_FEATURE (13)..(13): X is F or P
  MISC_FEATURE (14)..(14): X is K, R or H for basic amino acids
XXXXXXXXXXXXXX

SEQ ID NO: 522 - protein, 11 aa, Artificial
  Completely synthesized peptide construct
  MISC_FEATURE (1)..(1): X is F or P
  MISC_FEATURE (2)..(2): X is GabaX for X2X3 or X3X2 or X2X3 or X3X2 or X3X3 or X2X2
  MISC_FEATURE (3)..(3): X is K, R or H for basic amino acids
  MISC_FEATURE (4)..(4): X is F or P
  MISC_FEATURE (5)..(5): X is F or P
  MISC_FEATURE (6)..(6): X is K, R or H for basic amino acids
  MISC_FEATURE (7)..(7): X is N or Q for amidated amino acids
  MISC_FEATURE (8)..(8): X is GabaX for X2X3 or X3X2 or X2X3 or X3X2 or X3X3 or X2X2
  MISC_FEATURE (9)..(9): X is T or S
  MISC_FEATURE (10)..(10): X is F or P
  MISC_FEATURE (11)..(11): X is K, R or H for basic amino acids
XXXXXXXXXXX

SEQ ID NO: 523 - protein, 12 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is F or P
  MISC_FEATURE (3)..(3): X is GabaX for X2X3 or X3X2 or X2X3 or X3X2 or X3X3 or X2X2
  MISC_FEATURE (4)..(4): X is K, R or H for basic amino acids
  MISC_FEATURE (5)..(5): X is F or P
  MISC_FEATURE (6)..(6): X is F or P
  MISC_FEATURE (7)..(7): X is K, R or H for basic amino acids
  MISC_FEATURE (8)..(8): X is N or Q for amidated amino acids
  MISC_FEATURE (9)..(9): X is GabaX for X2X3 or X3X2 or X2X3 or X3X2 or X3X3 or X2X2
  MISC_FEATURE (10)..(10): X is T or S
  MISC_FEATURE (11)..(11): X is F or P
  MISC_FEATURE (12)..(12): X is K, R or H for basic amino acids
XXXXXXXXXXXX

SEQ ID NO: 524 - protein, 13 aa, Homo sapiens
HSLGKWLGHPDKF

SEQ ID NO: 525 - protein, 13 aa, Artificial
  Completely synthesized peptide construct
  MISC_FEATURE (1)..(1): X is K, R or H for basic amino acids
  MISC_FEATURE (2)..(2): X is T or S
  MISC_FEATURE (3)..(3): X is I, L or V
  MISC_FEATURE (4)..(4): X is A and G
  MISC_FEATURE (5)..(5): X is K, R or H for basic amino acids
  MISC_FEATURE (6)..(6): X is F, W or Y for aromatic amino acids
  MISC_FEATURE (7)..(7): X is I, L or V
  MISC_FEATURE (8)..(8): X is A and G
  MISC_FEATURE (9)..(9): X is K, R or H for basic amino acids
  MISC_FEATURE (10)..(10): X is F or P
  MISC_FEATURE (11)..(11): X is D and E for acidic amino acids
  MISC_FEATURE (12)..(12): X is K, R or H for basic amino acids
  MISC_FEATURE (13)..(13): X is F or P
XXXXXXXXXXXXX

SEQ ID NO: 526 - protein, 14 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is K, R or H for basic amino acids
  MISC_FEATURE (3)..(3): X is T or S
  MISC_FEATURE (4)..(4): X is I, L or V
  MISC_FEATURE (5)..(5): X is A and G
  MISC_FEATURE (6)..(6): X is K, R or H for basic amino acids
  MISC_FEATURE (7)..(7): X is F, W or Y for aromatic amino acids
  MISC_FEATURE (8)..(8): X is I, L or V
  MISC_FEATURE (9)..(9): X is A and G
  MISC_FEATURE (10)..(10): X is K, R or H for basic amino acids
  MISC_FEATURE (11)..(11): X is F or P
  MISC_FEATURE (12)..(12): X is D and E for acidic amino acids
  MISC_FEATURE (13)..(13): X is K, R or H for basic amino acids
  MISC_FEATURE (14)..(14): X is F or P
XXXXXXXXXXXXXX

SEQ ID NO: 527 - protein, 11 aa, Homo sapiens
TEISFKLGQEF

SEQ ID NO: 528 - protein, 11 aa, Artificial
  Completely synthesized peptide construct
  MISC_FEATURE (1)..(1): X is T or S
  MISC_FEATURE (2)..(2): X is D and E for acidic amino acids
  MISC_FEATURE (3)..(3): X is I, L or V
  MISC_FEATURE (4)..(4): X is T or S
  MISC_FEATURE (5)..(5): X is F or P
  MISC_FEATURE (6)..(6): X is K, R or H for basic amino acids
  MISC_FEATURE (7)..(7): X is K, R or H for basic amino acids
  MISC_FEATURE (8)..(8): X is A and G
  MISC_FEATURE (9)..(9): X is N or Q for amidated amino acids
  MISC_FEATURE (10)..(10): X is D and E for acidic amino acids
  MISC_FEATURE (11)..(11): X is F or P
XXXXXXXXXXX

SEQ ID NO: 529 - protein, 10 aa, Artificial
  Completely synthesized peptide construct
  MISC_FEATURE (1)..(1): X is T or S
  MISC_FEATURE (2)..(2): X is GabaX for X2X3 or X3X2 or X2X3 or X3X2 or X3X3 or X2X2
  MISC_FEATURE (3)..(3): X is T or S
  MISC_FEATURE (4)..(4): X is F or P
  MISC_FEATURE (5)..(5): X is K, R or H for basic amino acids
  MISC_FEATURE (6)..(6): X is K, R or H for basic amino acids
  MISC_FEATURE (7)..(7): X is A and G
  MISC_FEATURE (8)..(8): X is N or Q for amidated amino acids
  MISC_FEATURE (9)..(9): X is D and E for acidic amino acids
  MISC_FEATURE (10)..(10): X is F or P
XXXXXXXXXX

SEQ ID NO: 530 - protein, 12 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is D and E for acidic amino acids
  MISC_FEATURE (4)..(4): X is I, L or V
  MISC_FEATURE (5)..(5): X is T or S
  MISC_FEATURE (6)..(6): X is F or P
  MISC_FEATURE (7)..(7): X is K, R or H for basic amino acids
  MISC_FEATURE (8)..(8): X is K, R or H for basic amino acids
  MISC_FEATURE (9)..(9): X is A and G
  MISC_FEATURE (10)..(10): X is N or Q for amidated amino acids
  MISC_FEATURE (11)..(11): X is D and E for acidic amino acids
  MISC_FEATURE (12)..(12): X is F or P
XXXXXXXXXXXX

SEQ ID NO: 531 - protein, 11 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is GabaX for X2X3 or X3X2 or X2X3 or X3X2 or X3X3 or X2X2
  MISC_FEATURE (4)..(4): X is T or S
  MISC_FEATURE (5)..(5): X is F or P
  MISC_FEATURE (6)..(6): X is K, R or H for basic amino acids
  MISC_FEATURE (7)..(7): X is K, R or H for basic amino acids
  MISC_FEATURE (8)..(8): X is A and G
  MISC_FEATURE (9)..(9): X is N or Q for amidated amino acids
  MISC_FEATURE (10)..(10): X is D and E for acidic amino acids
  MISC_FEATURE (11)..(11): X is F or P
XXXXXXXXXXX

SEQ ID NO: 532 - protein, 11 aa, Artificial
  Completely synthesized peptide construct
SLDGELKALFK

SEQ ID NO: 533 - protein, 11 aa, Artificial
  Completely synthesized peptide construct
  MISC_FEATURE (1)..(1): X is T or S
  MISC_FEATURE (2)..(2): X is I, L or V
  MISC_FEATURE (3)..(3): X is D and E for acidic amino acids
  MISC_FEATURE (4)..(4): X is A and G
  MISC_FEATURE (5)..(5): X is D and E for acidic amino acids
  MISC_FEATURE (6)..(6): X is I, L or V
  MISC_FEATURE (7)..(7): X is K, R or H for basic amino acids
  MISC_FEATURE (8)..(8): X is A and G
  MISC_FEATURE (9)..(9): X is I, L or V
  MISC_FEATURE (10)..(10): X is F or P
  MISC_FEATURE (11)..(11): X is K, R or H for basic amino acids
XXXXXXXXXXX

SEQ ID NO: 534 - protein, 10 aa, Artificial
  Completely synthesized peptide construct
  MISC_FEATURE (1)..(1): X is T or S
  MISC_FEATURE (2)..(2): X  is  GabaX for X2X3 or X3X2 or X2X3 or X3X2 or X3X3 or X2X2
  MISC_FEATURE (3)..(3): X is A and G
  MISC_FEATURE (4)..(4): X is D and E for acidic amino acids
  MISC_FEATURE (5)..(5): X is I, L or V
  MISC_FEATURE (6)..(6): X is K, R or H for basic amino acids
  MISC_FEATURE (7)..(7): X is A and G
  MISC_FEATURE (8)..(8): X is I, L or V
  MISC_FEATURE (9)..(9): X is F or P
  MISC_FEATURE (10)..(10): X is K, R or H for basic amino acids
XXXXXXXXXX

SEQ ID NO: 535 - protein, 10 aa, Artificial
  Completely synthesized peptide construct
  MISC_FEATURE (1)..(1): X is T or S
  MISC_FEATURE (2)..(2): X is I, L or V
  MISC_FEATURE (3)..(3): X is D and E for acidic amino acids
  MISC_FEATURE (4)..(4): X is A and G
  MISC_FEATURE (5)..(5): X is GabaX for X2X3 or X3X2 or X2X3 or X3X2 or X3X3 or X2X2
  MISC_FEATURE (6)..(6): X is K, R or H for basic amino acids
  MISC_FEATURE (7)..(7): X is A and G
  MISC_FEATURE (8)..(8): X is I, L or V
  MISC_FEATURE (9)..(9): X is F or P
  MISC_FEATURE (10)..(10): X is K, R or H for basic amino acids
XXXXXXXXXX

SEQ ID NO: 536 - protein, 9 aa, Artificial
  Completely synthesized peptide construct
  MISC_FEATURE (1)..(1): X is T or S
  MISC_FEATURE (2)..(2): X is GabaX for X2X3 or X3X2 or X2X3 or X3X2 or X3X3 or X2X2
  MISC_FEATURE (3)..(3): X is A and G
  MISC_FEATURE (4)..(4): X is GabaX for X2X3 or X3X2 or X2X3 or X3X2 or X3X3 or X2X2
  MISC_FEATURE (5)..(5): X is K, R or H for basic amino acids
  MISC_FEATURE (6)..(6): X is A and G
  MISC_FEATURE (7)..(7): X is I, L or V
  MISC_FEATURE (8)..(8): X is F or P
  MISC_FEATURE (9)..(9): X is K, R or H for basic amino acids
XXXXXXXXX

SEQ ID NO: 537 - protein, 12 aa, Artificial
  Completely synthesized peptide construct
  MISC_FEATURE (1)..(1): X is acetyl or proionyl group, D glycine or D alanine, cyclohexylalanine at amino terminus
  MISC_FEATURE (2)..(2): X is T or S
  MISC_FEATURE (3)..(3): X is I, L or V
  MISC_FEATURE (4)..(4): X is D and E for acidic amino acids
  MISC_FEATURE (5)..(5): X is A and G
  MISC_FEATURE (6)..(6): X is D and E for acidic amino acids
  MISC_FEATURE (7)..(7): X is I, L or V
  MISC_FEATURE (8)..(8): X is K, R or H for basic amino acids
  MISC_FEATURE (9)..(9): X is A and G
  MISC_FEATURE (10)..(10): X is I, L or V
  MISC_FEATURE (11)..(11): X is F or P
  MISC_FEATURE (12)..(12): X is K, R or H for basic amino acids
XXXXXXXXXXXX

SEQ ID NO: 538 - protein, 11 aa, Artificial
  Completely synthesized peptide construct
  MISC_FEATURE (1)..(1): X is aceytl or propionyl group, D glycine or D alanine, cyclohexylalanine at amino terminus
  MISC_FEATURE (2)..(2): X is T or S
  MISC_FEATURE (3)..(3): X is GabaX for X2X3 or X3X2 or X2X3 or X3X2 or X3X3 or X2X2
  MISC_FEATURE (4)..(4): X is A and G
  MISC_FEATURE (5)..(5): X is D and E for acidic amino acids
  MISC_FEATURE (6)..(6): X is I, L or V
  MISC_FEATURE (7)..(7): X is K, R or H for basic amino acids
  MISC_FEATURE (8)..(8): X is A and G
  MISC_FEATURE (9)..(9): X is I, L or V
  MISC_FEATURE (10)..(10): X is F or P
  MISC_FEATURE (11)..(11): X is K, R or H for basic amino acids
XXXXXXXXXXX

SEQ ID NO: 539 - protein, 11 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is I, L or V
  MISC_FEATURE (4)..(4): X is D and E for acidic amino acids
  MISC_FEATURE (5)..(5): X is A and G
  MISC_FEATURE (6)..(6): X is GabaX for X2X3 or X3X2 or X2X3 or X3X2 or X3X3 or X2X2
  MISC_FEATURE (7)..(7): X is K, R or H for basic amino acids
  MISC_FEATURE (8)..(8): X is A and G
  MISC_FEATURE (9)..(9): X is I, L or V
  MISC_FEATURE (10)..(10): X is F or P
  MISC_FEATURE (11)..(11): X is K, R or H for basic amino acids
XXXXXXXXXXX

SEQ ID NO: 540 - protein, 10 aa, Artificial
  Completely synthesized peptide construct
  MISC_FEATURE (1)..(1): X is aceytl or propionyl group, D glycine or D alanine, cyclohexylalanine at amino terminus
  MISC_FEATURE (2)..(2): X is T or S
  MISC_FEATURE (3)..(3): X is GabaX for X2X3 or X3X2 or X2X3 or X3X2 or X3X3 or X2X2
  MISC_FEATURE (4)..(4): X is A and G
  MISC_FEATURE (5)..(5): X is GabaX for X2X3 or X3X2 or X2X3 or X3X2 or X3X3 or X2X2
  MISC_FEATURE (6)..(6): X is K, R or H for basic amino acids
  MISC_FEATURE (7)..(7): X is A and G
  MISC_FEATURE (8)..(8): X is I, L or V
  MISC_FEATURE (9)..(9): X is F or P
  MISC_FEATURE (10)..(10): X is K, R or H for basic amino acids
XXXXXXXXXX

SEQ ID NO: 541 - protein, 7 aa, Artificial
  Completely synthesized peptide construct
FKNIVTP

SEQ ID NO: 542 - protein, 7 aa, Artificial
  Completely synthesized peptide construct
  MISC_FEATURE (1)..(1): X is F or P
  MISC_FEATURE (2)..(2): X is K, R or H for basic amino acids
  MISC_FEATURE (3)..(3): X is N or Q for amidated amino acids
  MISC_FEATURE (4)..(4): X is I, L or V
  MISC_FEATURE (5)..(5): X is I, L or V
  MISC_FEATURE (6)..(6): X is T or S
  MISC_FEATURE (7)..(7): X is F or P
XXXXXXX

SEQ ID NO: 543 - protein, 6 aa, Artificial
  Completely synthesized peptide construct
  MISC_FEATURE (1)..(1): X is F or P
  MISC_FEATURE (2)..(2): X is K, R or H for basic amino acids
  MISC_FEATURE (3)..(3): X is N or Q for amidated amino acids
  MISC_FEATURE (4)..(4): X is GabaX for X2X3 or X3X2 or X2X3 or X3X2 or X3X3 or X2X2
  MISC_FEATURE (5)..(5): X is T or S
  MISC_FEATURE (6)..(6): X is F or P
XXXXXX

SEQ ID NO: 544 - protein, 8 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is F or P
  MISC_FEATURE (3)..(3): X is K, R or H for basic amino acids
  MISC_FEATURE (4)..(4): X is N or Q for amidated amino acids
  MISC_FEATURE (5)..(5): X is I, L or V
  MISC_FEATURE (6)..(6): X is I, L or V
  MISC_FEATURE (7)..(7): X is T or S
  MISC_FEATURE (8)..(8): X is F or P
XXXXXXXX

SEQ ID NO: 545 - protein, 7 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is F or P
  MISC_FEATURE (3)..(3): X is K, R or H for basic amino acids
  MISC_FEATURE (4)..(4): X is N or Q for amidated amino acids
  MISC_FEATURE (5)..(5): X is GabaX for X2X3 or X3X2 or X2X3 or X3X2 or X3X3 or X2X2
  MISC_FEATURE (6)..(6): X is T or S
  MISC_FEATURE (7)..(7): X is F or P
XXXXXXX

SEQ ID NO: 546 - protein, 14 aa, Artificial
  Completely synthesized peptide construct
NTWTTCQSIAFPSK

SEQ ID NO: 547 - protein, 14 aa, Artificial
  Completely synthesized peptide construct
  MISC_FEATURE (1)..(1): X is N or Q for amidated amino acids
  MISC_FEATURE (2)..(2): X is T or S
  MISC_FEATURE (3)..(3): X is F, W or Y for aromatic amino acids
  MISC_FEATURE (4)..(4): X is T or S
  MISC_FEATURE (5)..(5): X is T or S
  MISC_FEATURE (6)..(6): X is C or S
  MISC_FEATURE (7)..(7): X is N or Q for amidated amino acids
  MISC_FEATURE (8)..(8): X is M or Nle (Norleucine)
  MISC_FEATURE (9)..(9): X is I, L or V
  MISC_FEATURE (10)..(10): X is A and G
  MISC_FEATURE (11)..(11): X is F or P
  MISC_FEATURE (12)..(12): X is F or P
  MISC_FEATURE (13)..(13): X is T or S
  MISC_FEATURE (14)..(14): X is K, R or H for basic amino acids
XXXXXXXXXXXXXX

SEQ ID NO: 548 - protein, 15 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is N or Q for amidated amino acids
  MISC_FEATURE (3)..(3): X is T or S
  MISC_FEATURE (4)..(4): X is F, W or Y for aromatic amino acids
  MISC_FEATURE (5)..(5): X is T or S
  MISC_FEATURE (6)..(6): X is T or S
  MISC_FEATURE (7)..(7): X is C or S
  MISC_FEATURE (8)..(8): X is N or Q for amidated amino acids
  MISC_FEATURE (9)..(9): X is T or S
  MISC_FEATURE (10)..(10): X is I, L or V
  MISC_FEATURE (11)..(11): X is A and G
  MISC_FEATURE (12)..(12): X is F or P
  MISC_FEATURE (13)..(13): X is F or P
  MISC_FEATURE (14)..(14): X is T or S
  MISC_FEATURE (15)..(15): X is K, R or H for basic amino acids
XXXXXXXXXXXXXXX

SEQ ID NO: 549 - protein, 18 aa, Homo sapiens
IYFNTWTTCQSIAFPSKT

SEQ ID NO: 550 - protein, 18 aa, Artificial
  Completely synthesized peptide construct
  MISC_FEATURE (1)..(1): X is I, L or V
  MISC_FEATURE (2)..(2): X is F, W or Y for aromatic amino acids
  MISC_FEATURE (3)..(3): X is F, W or Y for aromatic amino acids
  MISC_FEATURE (4)..(4): X is N or Q for amidated amino acids
  MISC_FEATURE (5)..(5): X is T or S
  MISC_FEATURE (6)..(6): X is F, W or Y for aromatic amino acids
  MISC_FEATURE (7)..(7): X is T or S
  MISC_FEATURE (8)..(8): X is T or S
  MISC_FEATURE (9)..(9): X is C or S
  MISC_FEATURE (10)..(10): X is N or Q for amidated amino acids
  MISC_FEATURE (11)..(11): X is T or s
  MISC_FEATURE (12)..(12): X is I, L or V
  MISC_FEATURE (13)..(13): X is A and G
  MISC_FEATURE (14)..(14): X is F or P
  MISC_FEATURE (15)..(15): X is F or P
  MISC_FEATURE (16)..(16): X is T or S
  MISC_FEATURE (17)..(17): X is K, R or H for basic amino acids
  MISC_FEATURE (18)..(18): X is T or S
XXXXXXXXXXXXXXXXXX

SEQ ID NO: 551 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is I, L or V
  MISC_FEATURE (3)..(3): X is F, W or Y for aromatic amino acids
  MISC_FEATURE (4)..(4): X is F, W or Y or aromatic amino acids
  MISC_FEATURE (5)..(5): X is N or Q for amidated amino acids
  MISC_FEATURE (6)..(6): X is T or S
  MISC_FEATURE (7)..(7): X is F, W or Y for aromatic amino acids
  MISC_FEATURE (8)..(8): X is T or S
  MISC_FEATURE (9)..(9): X is T or S
  MISC_FEATURE (10)..(10): X is C or S
  MISC_FEATURE (11)..(11): X is N or Q for amidated amino acids
  MISC_FEATURE (12)..(12): X is T or S
  MISC_FEATURE (13)..(13): X is I, L or V
  MISC_FEATURE (14)..(14): X is A and G
  MISC_FEATURE (15)..(15): X is F or P
  MISC_FEATURE (16)..(16): X is F or P
  MISC_FEATURE (17)..(17): X is T or S
  MISC_FEATURE (18)..(18): X is K, R or H for basic amino acids
  MISC_FEATURE (19)..(19): X is T or S
XXXXXXXXXXXXXXXXXXX

SEQ ID NO: 552 - protein, 23 aa, Homo sapiens
QKFSEHFSIHCCPPFTFLNSSKR

SEQ ID NO: 553 - protein, 23 aa, Artificial
  Completely synthesized peptide construct
  MISC_FEATURE (1)..(1): X is N or Q for amidated amino acids
  MISC_FEATURE (2)..(2): X is K, R or H for basic amino acids
  MISC_FEATURE (3)..(3): X is F, W or Y for aromatic amino acids
  MISC_FEATURE (4)..(4): X is T or S
  MISC_FEATURE (5)..(5): X is D and E for acidic amino acids
  MISC_FEATURE (6)..(6): X is K, R or H for basic amino acids
  MISC_FEATURE (7)..(7): X is F or P
  MISC_FEATURE (8)..(8): X is T or S
  MISC_FEATURE (9)..(9): X is I, L or V
  MISC_FEATURE (10)..(10): X is K, R or H for basic amino acids
  MISC_FEATURE (11)..(11): X is C or S
  MISC_FEATURE (12)..(12): X is C or S
  MISC_FEATURE (13)..(13): X is F or P
  MISC_FEATURE (14)..(14): X is F or P
  MISC_FEATURE (15)..(15): X is F, W or Y for aromatic amino acids
  MISC_FEATURE (16)..(16): X is T or S
  MISC_FEATURE (17)..(17): X is F, W or Y for aromatic amino acids
  MISC_FEATURE (18)..(18): X is I, L or V
  MISC_FEATURE (19)..(19): X is N or Q for amidated amino acids
  MISC_FEATURE (20)..(20): X is T or S
  MISC_FEATURE (21)..(21): X is T or S
  MISC_FEATURE (22)..(22): X is K, R or H for basic amino acids
  MISC_FEATURE (23)..(23): X is K, R or H for basic amino acids
XXXXXXXXXXXXXXXXXXXXXXX

SEQ ID NO: 554 - protein, 24 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is N or Q for amidated amino acids
  MISC_FEATURE (3)..(3): X is K, R or H for basic amino acids
  MISC_FEATURE (4)..(4): X is F, W or Y for aromatic amino acids
  MISC_FEATURE (5)..(5): X is T or S
  MISC_FEATURE (6)..(6): X is D and E for acidic amino acids
  MISC_FEATURE (7)..(7): X is K, R or H for basic amino acids
  MISC_FEATURE (8)..(8): X is F or P
  MISC_FEATURE (9)..(9): X is T or S
  MISC_FEATURE (10)..(10): X is K, R or H for basic amino acids
  MISC_FEATURE (11)..(11): X is K, R or H for basic amino acids
  MISC_FEATURE (12)..(12): X is C or S
  MISC_FEATURE (13)..(13): X is C or S
  MISC_FEATURE (14)..(14): X is F or P
  MISC_FEATURE (15)..(15): X is F or P
  MISC_FEATURE (16)..(16): X is F, W or Y for aromatic amino acids
  MISC_FEATURE (17)..(17): X is T or S
  MISC_FEATURE (18)..(18): X is F, W or Y for aromatic amino acids
  MISC_FEATURE (19)..(19): X is I, L or V
  MISC_FEATURE (20)..(20): X is N or Q for amidated amino acids
  MISC_FEATURE (21)..(21): X is T or S
  MISC_FEATURE (22)..(22): X is T or S
  MISC_FEATURE (23)..(23): X is K, R or H for basic amino acids
  MISC_FEATURE (24)..(24): X is K, R or H for basic amino acids
XXXXXXXXXXXXXXXXXXXXXXXX

SEQ ID NO: 555 - protein, 20 aa, Homo sapiens
GQFRVIGPRHPIRALVGDEV

SEQ ID NO: 556 - protein, 20 aa, Artificial
  Completely synthesized peptide construct
  MISC_FEATURE (1)..(1): X is A and G
  MISC_FEATURE (2)..(2): X is N or Q for amidated amino acids
  MISC_FEATURE (3)..(3): X is F, W or Y for aromatic amino acids
  MISC_FEATURE (4)..(4): X is K, R or H for basic amino acids
  MISC_FEATURE (5)..(5): X is I, L or V
  MISC_FEATURE (6)..(6): X is I, L or V
  MISC_FEATURE (7)..(7): X is A and G
  MISC_FEATURE (8)..(8): X is F or P
  MISC_FEATURE (9)..(9): X is K, R or H for basic amino acids
  MISC_FEATURE (10)..(10): X is K, R or H for basic amino acids
  MISC_FEATURE (11)..(11): X is F or P
  MISC_FEATURE (12)..(12): X is I, L or V
  MISC_FEATURE (13)..(13): X is K, R or H for basic amino acids
  MISC_FEATURE (14)..(14): X is A and G
  MISC_FEATURE (15)..(15): X is I, L or V
  MISC_FEATURE (16)..(16): X is I, L or V
  MISC_FEATURE (17)..(17): X is A and G
  MISC_FEATURE (18)..(18): X is D and E for acidic amino acids
  MISC_FEATURE (19)..(19): X is D and E for acidic amino acids
  MISC_FEATURE (20)..(20): X is I, L or V
XXXXXXXXXXXXXXXXXXXX

SEQ ID NO: 557 - protein, 20 aa, Artificial
  Completely synthesized peptide construct
  MISC_FEATURE (1)..(1): X is A and G
  MISC_FEATURE (2)..(2): X is N or Q for amidated amino acids
  MISC_FEATURE (3)..(3): X is F, W or Y for aromatic amino acids
  MISC_FEATURE (4)..(4): X is K, R or H for basic amino acids
  MISC_FEATURE (5)..(5): X is I, L or V
  MISC_FEATURE (6)..(6): X is I, L or V
  MISC_FEATURE (7)..(7): X is A and G
  MISC_FEATURE (8)..(8): X is F or P
  MISC_FEATURE (9)..(9): X is K, R or H for basic amino acids
  MISC_FEATURE (10)..(10): X is K, R or H for basic amino acids
  MISC_FEATURE (11)..(11): X is F or P
  MISC_FEATURE (12)..(12): X is I, L or V
  MISC_FEATURE (13)..(13): X is K, R or H for basic amino acids
  MISC_FEATURE (14)..(14): X is A and G
  MISC_FEATURE (15)..(15): X is I, L or V
  MISC_FEATURE (16)..(16): X is I, L or V
  MISC_FEATURE (17)..(17): X is A and G
  MISC_FEATURE (18)..(18): X is D and E for acidic amino acids
  MISC_FEATURE (19)..(19): X is D and E for acidic amino acids
  MISC_FEATURE (20)..(20): X is I, L or V
XXXXXXXXXXXXXXXXXXXX

SEQ ID NO: 558 - protein, 19 aa, Artificial
  Completely synthesized peptide construct
  MISC_FEATURE (1)..(1): X is A and G
  MISC_FEATURE (2)..(2): X is N or Q for amidated amino acids
  MISC_FEATURE (3)..(3): X is F, W or Y for aromatic amino acids
  MISC_FEATURE (4)..(4): X is K, R or H for basic amino acids
  MISC_FEATURE (5)..(5): X is GabaX for X2X3 or X3X2 or X2X3 or X3X2 or X3X3 or X2X2
  MISC_FEATURE (6)..(6): X is A and G
  MISC_FEATURE (7)..(7): X is F or P
  MISC_FEATURE (8)..(8): X is K, R or H for basic amino acids
  MISC_FEATURE (9)..(9): X is K, R or H for basic amino acids
  MISC_FEATURE (10)..(10): X is F or P
  MISC_FEATURE (11)..(11): X is I, L or V
  MISC_FEATURE (12)..(12): X is K, R or H for basic amino acids
  MISC_FEATURE (13)..(13): X is A and G
  MISC_FEATURE (14)..(14): X is I, L or V
  MISC_FEATURE (15)..(15): X is I, L or V
  MISC_FEATURE (16)..(16): X is A and G
  MISC_FEATURE (17)..(17): X is D and E for acidic amino acids
  MISC_FEATURE (18)..(18): X is D and E for acidic amino acids
  MISC_FEATURE (19)..(19): X is I, L or V
XXXXXXXXXXXXXXXXXXX

SEQ ID NO: 559 - protein, 19 aa, Artificial
  Completely synthesized peptide construct
  MISC_FEATURE (1)..(1): X is A and G
  MISC_FEATURE (2)..(2): X is N or Q for amidated amino acids
  MISC_FEATURE (3)..(3): X is F, W or Y for aromatic amino acids
  MISC_FEATURE (4)..(4): X is K, R or H for basic amino acids
  MISC_FEATURE (5)..(5): X is I, L or V
  MISC_FEATURE (6)..(6): X is I, L or V
  MISC_FEATURE (7)..(7): X is A and G
  MISC_FEATURE (8)..(8): X is F or P
  MISC_FEATURE (9)..(9): X is K, R or H for basic amino acids
  MISC_FEATURE (10)..(10): X is K, R or H for basic amino acids
  MISC_FEATURE (11)..(11): X is F or P
  MISC_FEATURE (12)..(12): X is I, L or V
  MISC_FEATURE (13)..(13): X is K, R or H for basic amino acids
  MISC_FEATURE (14)..(14): X is A and G
  MISC_FEATURE (15)..(15): X is GabaX for X2X3 or X3X2 or X2X3 or X3X2 or X3X3 or X2X2
  MISC_FEATURE (16)..(16): X is A and G
  MISC_FEATURE (17)..(17): X is D and E for acidic amino acids
  MISC_FEATURE (18)..(18): X is D and E for acidic amino acids
  MISC_FEATURE (19)..(19): X is I, L or V
XXXXXXXXXXXXXXXXXXX

SEQ ID NO: 560 - protein, 18 aa, Artificial
  Completely synthesized peptide construct
  MISC_FEATURE (1)..(1): X is A and G
  MISC_FEATURE (2)..(2): X is N or Q for amidated amino acids
  MISC_FEATURE (3)..(3): X is F, W or Y for aromatic amino acids
  MISC_FEATURE (4)..(4): X is K, R or H for basic amino acids
  MISC_FEATURE (5)..(5): X is I, L or V
  MISC_FEATURE (6)..(6): X is I, L or V
  MISC_FEATURE (7)..(7): X is A and G
  MISC_FEATURE (8)..(8): X is F or P
  MISC_FEATURE (9)..(9): X is K, R or H for basic amino acids
  MISC_FEATURE (10)..(10): X is K, R or H for basic amino acids
  MISC_FEATURE (11)..(11): X is F or P
  MISC_FEATURE (12)..(12): X is I, L or V
  MISC_FEATURE (13)..(13): X is K, R or H for basic amino acids
  MISC_FEATURE (14)..(14): X is A and G
  MISC_FEATURE (15)..(15): X is I, L or V
  MISC_FEATURE (16)..(16): X is I, L or V
  MISC_FEATURE (17)..(17): X is A and G
  MISC_FEATURE (18)..(18): X is GabaX for X2X3 or X3X2 or X2X3 or X3X2 or X3X3 or X2X2
XXXXXXXXXXXXXXXXXX

SEQ ID NO: 561 - protein, 18 aa, Artificial
  Completely synthesized peptide construct
  MISC_FEATURE (1)..(1): X is A and G
  MISC_FEATURE (2)..(2): X is N or Q for amidated amino acids
  MISC_FEATURE (3)..(3): X is F, W or Y for aromatic amino acids
  MISC_FEATURE (4)..(4): X is K, R or H for basic amino acids
  MISC_FEATURE (5)..(5): X is GabaX for X2X3 or X3X2 or X2X3 or X3X2 or X3X3 or X2X2
  MISC_FEATURE (6)..(6): X is A and G
  MISC_FEATURE (7)..(7): X is F or P
  MISC_FEATURE (8)..(8): X is K, R or H for basic amino acids
  MISC_FEATURE (9)..(9): X is K, R or H for basic amino acids
  MISC_FEATURE (10)..(10): X is F or P
  MISC_FEATURE (11)..(11): X is I, L or V
  MISC_FEATURE (12)..(12): X is K, R or H for basic amino acids
  MISC_FEATURE (13)..(13): X is A and G
  MISC_FEATURE (14)..(14): X is GabaX for X2X3 or X3X2 or X2X3 or X3X2 or X3X3 or X2X2
  MISC_FEATURE (15)..(15): X is A and G
  MISC_FEATURE (16)..(16): X is D and E for acidic amino acids
  MISC_FEATURE (17)..(17): X is D and E for acidic amino acids
  MISC_FEATURE (18)..(18): X is I, L or V
XXXXXXXXXXXXXXXXXX

SEQ ID NO: 562 - protein, 16 aa, Artificial
  Completely synthesized peptide construct
  MISC_FEATURE (1)..(1): X is A and G
  MISC_FEATURE (2)..(2): X is N or Q for amidated amino acids
  MISC_FEATURE (3)..(3): X is F, W or Y for aromatic amino acids
  MISC_FEATURE (4)..(4): X is K, R or H for basic amino acids
  MISC_FEATURE (5)..(5): X is GabaX for X2X3 or X3X2 or X2X3 or X3X2 or X3X3 or X2X2
  MISC_FEATURE (6)..(6): X is A and G
  MISC_FEATURE (7)..(7): X is F or P
  MISC_FEATURE (8)..(8): X is K, R or H for basic amino acids
  MISC_FEATURE (9)..(9): X is K, R or H for basic amino acids
  MISC_FEATURE (10)..(10): X is F or P
  MISC_FEATURE (11)..(11): X is I, L or V
  MISC_FEATURE (12)..(12): X is K, R or H for basic amino acids
  MISC_FEATURE (13)..(13): X is A and G
  MISC_FEATURE (14)..(14): X is GabaX for X2X3 or X3X2 or X2X3 or X3X2 or X3X3 or X2X2
  MISC_FEATURE (15)..(15): X is A and G
  MISC_FEATURE (16)..(16): X is GabaX for X2X3 or X3X2 or X2X3 or X3X2 or X3X3 or X2X2
XXXXXXXXXXXXXXXX

SEQ ID NO: 563 - protein, 17 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is N or Q for amidated amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is GabaX for X2X3 or X3X2 or X2X3 or X3X2 or X3X3 or X2X2
  MISC_FEATURE (7)..(7): X is A and G
  MISC_FEATURE (8)..(8): X is F or P
  MISC_FEATURE (9)..(9): X is K, R or H for basic amino acids
  MISC_FEATURE (10)..(10): X is K, R or H for basic amino acids
  MISC_FEATURE (11)..(11): X is F or P
  MISC_FEATURE (12)..(12): X is I, L or V
  MISC_FEATURE (13)..(13): X is K, R or H for basic amino acids
  MISC_FEATURE (14)..(14): X is A and G
  MISC_FEATURE (15)..(15): X is GabaX for X2X3 or X3X2 or X2X3 or X3X2 or X3X3 or X2X2
  MISC_FEATURE (16)..(16): X is A and G
  MISC_FEATURE (17)..(17): X is GabaX for X2X3 or X3X2 or X2X3 or X3X2 or X3X3 or X2X2
XXXXXXXXXXXXXXXXX

SEQ ID NO: 564 - protein, 21 aa, Artificial
  Completely synthesized peptide construct
  MISC_FEATURE (1)..(1): X is acetyl or propionyl group, D glycine or D alanine, cyclodexylalanine at amino terminus
  MISC_FEATURE (2)..(2): X is A and G
  MISC_FEATURE (3)..(3): X is N or Q for amidated amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is I, L or V
  MISC_FEATURE (7)..(7): X is I, L or V
  MISC_FEATURE (8)..(8): X is A and G
  MISC_FEATURE (9)..(9): X is F or P
  MISC_FEATURE (10)..(10): X is K, R or H for basic amino acids
  MISC_FEATURE (11)..(11): X is K, R or H for basic amino acids
  MISC_FEATURE (12)..(12): X is F or P
  MISC_FEATURE (13)..(13): X is I, L or V
  MISC_FEATURE (14)..(14): X is K, R or H for basic amino acids
  MISC_FEATURE (15)..(15): X is A and G
  MISC_FEATURE (16)..(16): X is I, L or V
  MISC_FEATURE (17)..(17): X is I, L or V
  MISC_FEATURE (18)..(18): X is A and G
  MISC_FEATURE (19)..(19): X is D and E for acidic amino acids
  MISC_FEATURE (20)..(20): X is D and E for acidic amino acids
  MISC_FEATURE (21)..(21): X is I, L or V
XXXXXXXXXXXXXXXXXXXXX

SEQ ID NO: 565 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is N or Q for amidated amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is I, L or V
  MISC_FEATURE (7)..(7): X is I, L or V
  MISC_FEATURE (8)..(8): X is A and G
  MISC_FEATURE (9)..(9): X is F or P
  MISC_FEATURE (10)..(10): X is K, R or H for basic amino acids
  MISC_FEATURE (11)..(11): X is K, R or H for basic amino acids
  MISC_FEATURE (12)..(12): X is F or P
  MISC_FEATURE (13)..(13): X is I, L or V
  MISC_FEATURE (14)..(14): X is K, R or H for basic amino acids
  MISC_FEATURE (15)..(15): X is A and G
  MISC_FEATURE (16)..(16): X is I, L or V
  MISC_FEATURE (17)..(17): X is I, L or V
  MISC_FEATURE (18)..(18): X is A and G
  MISC_FEATURE (19)..(19): X is D and E for acidic amino acids
  MISC_FEATURE (20)..(20): X is D and E for acidic amino acids
  MISC_FEATURE (21)..(21): X is I, L or V
XXXXXXXXXXXXXXXXXXXXX

SEQ ID NO: 566 - protein, 20 aa, Artificial
  Completely synthesized peptide construct
  MISC_FEATURE (1)..(1): X is acetyl or propionyl group, D glycine or D alanine, cyclodexylalanine at amino terminus
  MISC_FEATURE (2)..(2): X is A and G
  MISC_FEATURE (3)..(3): X is N or Q for amidated amino terminus
  MISC_FEATURE (4)..(4): X is F, W or Y for aromatic amino acids
  MISC_FEATURE (5)..(5): X is K, R or H for basic amino acids
  MISC_FEATURE (6)..(6): X is GabaX for X2X3 or X3X2 or X2X3 or X3X2 or X3X3 or X2X2
  MISC_FEATURE (7)..(7): X is A and G
  MISC_FEATURE (8)..(8): X is F or P
  MISC_FEATURE (9)..(9): X is K, R or H for basic amino acids
  MISC_FEATURE (10)..(10): X is K, R or H for basic amino acids
  MISC_FEATURE (11)..(11): X is F or P
  MISC_FEATURE (12)..(12): X is I, L or V
  MISC_FEATURE (13)..(13): X is K, R or H for basic amino acids
  MISC_FEATURE (14)..(14): X is A and G
  MISC_FEATURE (15)..(15): X is I, L or V
  MISC_FEATURE (16)..(16): X is I, L or V
  MISC_FEATURE (17)..(17): X is A and G
  MISC_FEATURE (18)..(18): X is D and E for acidic amino acids
  MISC_FEATURE (19)..(19): X is D and E for acidic amino acids
  MISC_FEATURE (20)..(20): X is I, L or V
XXXXXXXXXXXXXXXXXXXX

SEQ ID NO: 567 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is N or Q for amidated amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is I, L or V
  MISC_FEATURE (7)..(7): X is I, L or V
  MISC_FEATURE (8)..(8): X is A and G
  MISC_FEATURE (9)..(9): X is F or P
  MISC_FEATURE (10)..(10): X is K, R or H for basic amino acids
  MISC_FEATURE (11)..(11): X is K, R or H for basic amino acids
  MISC_FEATURE (12)..(12): X is F or P
  MISC_FEATURE (13)..(13): X is I, L or V
  MISC_FEATURE (14)..(14): X is K, R or H for basic amino acids
  MISC_FEATURE (15)..(15): X is A and G
  MISC_FEATURE (16)..(16): X is GabaX for X2X3 or X3X2 or X2X3 or X3X2 or X3X3 or X2X2
  MISC_FEATURE (17)..(17): X is A and G
  MISC_FEATURE (18)..(18): X is D and E for acidic amino acids
  MISC_FEATURE (19)..(19): X is D and E for acidic amino acids
  MISC_FEATURE (20)..(20): X is I, L or V
XXXXXXXXXXXXXXXXXXXX

SEQ ID NO: 568 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is N or Q for amidated amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is I, L or V
  MISC_FEATURE (7)..(7): X is I, L or V
  MISC_FEATURE (8)..(8): X is A and G
  MISC_FEATURE (9)..(9): X is F or P
  MISC_FEATURE (10)..(10): X is K, R or H for basic amino acids
  MISC_FEATURE (11)..(11): X is K, R or H for basic amino acids
  MISC_FEATURE (12)..(12): X is F or P
  MISC_FEATURE (13)..(13): X is I, L or V
  MISC_FEATURE (14)..(14): X is K, R or H for basic amino acids
  MISC_FEATURE (15)..(15): X is A and G
  MISC_FEATURE (16)..(16): X is I, L or V
  MISC_FEATURE (17)..(17): X is I, L or V
  MISC_FEATURE (18)..(18): X is A and G
  MISC_FEATURE (19)..(19): X is GabaX for X2X3 or X3X2 or X2X3 or X3X2 or X3X3 or X2X2
XXXXXXXXXXXXXXXXXXX

SEQ ID NO: 569 - protein, 19 aa, Artificial
  Completely synthesized peptide construct
  MISC_FEATURE (1)..(1): X is acetyl or propionyl group, D glycine or D alanine, cyclodexylalanine at amino terminus
  MISC_FEATURE (2)..(2): X is A and G
  MISC_FEATURE (3)..(3): X is N or Q for amidated amino terminus
  MISC_FEATURE (4)..(4): X is F, W or Y for aromatic amino acids
  MISC_FEATURE (5)..(5): X is K, R or H for basic amino acids
  MISC_FEATURE (6)..(6): X is F, W or Y for aromatic amino acids
  MISC_FEATURE (7)..(7): X is A and G
  MISC_FEATURE (8)..(8): X is F or P
  MISC_FEATURE (9)..(9): X is K, R or H for basic amino acids
  MISC_FEATURE (10)..(10): X is K, R or H for basic amino acids
  MISC_FEATURE (11)..(11): X is F or P
  MISC_FEATURE (12)..(12): X is I, L or V
  MISC_FEATURE (13)..(13): X is K, R or H for basic amino acids
  MISC_FEATURE (14)..(14): X is A and G
  MISC_FEATURE (15)..(15): X is GabaX for X2X3 or X3X2 or X2X3 or X3X2 or X3X3 or X2X2
  MISC_FEATURE (16)..(16): X is A and G
  MISC_FEATURE (17)..(17): X is D and E for acidic amino acids
  MISC_FEATURE (18)..(18): X is D and E for acidic amino acids
  MISC_FEATURE (19)..(19): X is I, L or V
XXXXXXXXXXXXXXXXXXX

SEQ ID NO: 570 - protein, 17 aa, Artificial
  Completely synthesized peptide construct
  MISC_FEATURE (1)..(1): X is acetyl or propionyl group, D glycine or Dalanine, cyclohexylalanine at amino terminus
  MISC_FEATURE (2)..(2): X is A and G
  MISC_FEATURE (3)..(3): X is N or Q for amidated amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is GabaX for X2X3 or X3X2 or X2X3 or X3X2 or X3X3 or X2X2
  MISC_FEATURE (7)..(7): X is A and G
  MISC_FEATURE (8)..(8): X is F or P
  MISC_FEATURE (9)..(9): X is K, R or H for basic amino acids
  MISC_FEATURE (10)..(10): X is F or P
  MISC_FEATURE (11)..(11): X is I, L or V
  MISC_FEATURE (12)..(12): X is K, R or H for basic amino acids
  MISC_FEATURE (13)..(13): X is K, R or H for basic amino acids
  MISC_FEATURE (14)..(14): X is A and G
  MISC_FEATURE (15)..(15): X is GabaX for X2X3 or X3X2 or X2X3 or X3X2 or X3X3 or X2X2
  MISC_FEATURE (16)..(16): X is A and G
  MISC_FEATURE (17)..(17): X is GabaX for X2X3 or X3X2 or X2X3 or X3X2 or X3X3 or X2X2
XXXXXXXXXXXXXXXXX

SEQ ID NO: 571 - protein, 18 aa, Artificial
  Completely synthesized peptide construct
  MISC_FEATURE (1)..(1): X is acetyl or propionyl group, D glycine or D alanine, cyclodexylalanine at amino terminus
  MISC_FEATURE (2)..(2): X is A and G
  MISC_FEATURE (3)..(3): X is N or Q for amidated amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is GabaX for X2X3 or X3X2 or X2X3 or X3X2 or X3X3 or X2X2
  MISC_FEATURE (7)..(7): X is A and G
  MISC_FEATURE (8)..(8): X is F or P
  MISC_FEATURE (9)..(9): X is K, R or H for basic amino acids
  MISC_FEATURE (10)..(10): X is K, R or H for basic amino acids
  MISC_FEATURE (11)..(11): X is F or P
  MISC_FEATURE (12)..(12): X is I, L or V
  MISC_FEATURE (13)..(13): X is K, R or H for basic amino acids
  MISC_FEATURE (14)..(14): X is A and G
  MISC_FEATURE (15)..(15): X is I, L or V
  MISC_FEATURE (16)..(16): X is I, L or V
  MISC_FEATURE (17)..(17): X is A and G
  MISC_FEATURE (18)..(18): X is GabaX for X2X3 or X3X2 or X2X3 or X3X2 or X3X3 or X2X2
XXXXXXXXXXXXXXXXXX

SEQ ID NO: 572 - protein, 20 aa, Homo sapiens
NATGMEVGWYRPPFSRVVHL

SEQ ID NO: 573 - protein, 20 aa, Artificial
  Completely synthesized peptide construct
  MISC_FEATURE (1)..(1): X is N or Q for amidated amino acids
  MISC_FEATURE (2)..(2): X is A and G
  MISC_FEATURE (3)..(3): X is T or S
  MISC_FEATURE (4)..(4): X is A and G
  MISC_FEATURE (5)..(5): X is M or Nle (Norleucine)
  MISC_FEATURE (6)..(6): X is D and E for acidic amino acids
  MISC_FEATURE (7)..(7): X is I, L or V
  MISC_FEATURE (8)..(8): X is A and G
  MISC_FEATURE (9)..(9): X is F, W or Y for aromatic amino acids
  MISC_FEATURE (10)..(10): X is F, W or Y for aromatic amino acids
  MISC_FEATURE (11)..(11): X is K, R or H for basic amino acids
  MISC_FEATURE (12)..(12): X is F or P
  MISC_FEATURE (13)..(13): X is F or P
  MISC_FEATURE (14)..(14): X is F or P
  MISC_FEATURE (15)..(15): X is T or S
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is K, R or H for basic amino acids
  MISC_FEATURE (20)..(20): X is I, L or V
XXXXXXXXXXXXXXXXXXXX

SEQ ID NO: 574 - protein, 19 aa, Artificial
  Completely synthesized peptide construct
  MISC_FEATURE (1)..(1): X is N or Q for amidated amino acids
  MISC_FEATURE (2)..(2): X is A and G
  MISC_FEATURE (3)..(3): X is T or S
  MISC_FEATURE (4)..(4): X is A and G
  MISC_FEATURE (5)..(5): X is M or Nle (Norleucine)
  MISC_FEATURE (6)..(6): X is GabaX for X2X3 or X3X2 or X2X3 or X3X2 or X3X3 or X2X2
  MISC_FEATURE (7)..(7): X is A and G
  MISC_FEATURE (8)..(8): X is F, W or Y for aromatic amino acids
  MISC_FEATURE (9)..(9): X is F, W or Y for aromatic amino acids
  MISC_FEATURE (10)..(10): X is K, R or H for basic amino acids
  MISC_FEATURE (11)..(11): X is F or P
  MISC_FEATURE (12)..(12): X is F or P
  MISC_FEATURE (13)..(13): X is F or P
  MISC_FEATURE (14)..(14): X is T or S
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is K, R or H for basic amino acids
  MISC_FEATURE (19)..(19): X is I, L or V
XXXXXXXXXXXXXXXXXXX

SEQ ID NO: 575 - protein, 19 aa, Artificial
  Completely synthesized peptide construct
  MISC_FEATURE (1)..(1): X is N or Q for amidated amino acids
  MISC_FEATURE (2)..(2): X is A and G
  MISC_FEATURE (3)..(3): X is T or S
  MISC_FEATURE (4)..(4): X is A and G
  MISC_FEATURE (5)..(5): X is M or Nle (Norleucine)
  MISC_FEATURE (6)..(6): X is D and E for acidic amino acids
  MISC_FEATURE (7)..(7): X is I, L or V
  MISC_FEATURE (8)..(8): X is A and G
  MISC_FEATURE (9)..(9): X is F, W or Y for aromatic amino acids
  MISC_FEATURE (10)..(10): X is F, W or Y for aromatic amino acids
  MISC_FEATURE (11)..(11): X is K, R or H for basic amino acids
  MISC_FEATURE (12)..(12): X is F or P
  MISC_FEATURE (13)..(13): X is F or P
  MISC_FEATURE (14)..(14): X is F or P
  MISC_FEATURE (15)..(15): X is T or S
  MISC_FEATURE (16)..(16): X is K, R or H for basic amino acids
  MISC_FEATURE (17)..(17): X is GabaX for X2X3 or X3X2 or X2X3 or X3X2 or X3X3 or X2X2
  MISC_FEATURE (18)..(18): X is K, R or H for basic amino acids
  MISC_FEATURE (19)..(19): X is I, L or V
XXXXXXXXXXXXXXXXXXX

SEQ ID NO: 576 - protein, 18 aa, Artificial
  Completely synthesized peptide construct
  MISC_FEATURE (1)..(1): X is N or Q for amidated amino acids
  MISC_FEATURE (2)..(2): X is A and G
  MISC_FEATURE (3)..(3): X is T or S
  MISC_FEATURE (4)..(4): X is A and G
  MISC_FEATURE (5)..(5): X is M or Nle (Norleucine)
  MISC_FEATURE (6)..(6): X is GabaX for X2X3 or X3X2 or X2X3 or X3X2 or X3X3 or X2X2
  MISC_FEATURE (7)..(7): X is A and G
  MISC_FEATURE (8)..(8): X is F, W or Y for aromatic amino acids
  MISC_FEATURE (9)..(9): X is F, W or Y for aromatic amino acids
  MISC_FEATURE (10)..(10): X is K, R or H for basic amino acids
  MISC_FEATURE (11)..(11): X is F or P
  MISC_FEATURE (12)..(12): X is F or P
  MISC_FEATURE (13)..(13): X is F or P
  MISC_FEATURE (14)..(14): X is T or S
  MISC_FEATURE (15)..(15): X is K, R or H for basic amino acids
  MISC_FEATURE (16)..(16): X is GabaX for X2X3 or X3X2 or X2X3 or X3X2 or X3X3 or X2X2
  MISC_FEATURE (17)..(17): X is K, R or H for basic amino acids
  MISC_FEATURE (18)..(18): X is D and E for acidic amino acids
XXXXXXXXXXXXXXXXXX

SEQ ID NO: 577 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is N or Q for amidated amino acids
  MISC_FEATURE (3)..(3): X is A and G
  MISC_FEATURE (4)..(4): X is T or S
  MISC_FEATURE (5)..(5): X is A and G
  MISC_FEATURE (6)..(6): X is M or Nle (Norleucine)
  MISC_FEATURE (7)..(7): X is D and E for acidic amino acids
  MISC_FEATURE (8)..(8): X is I, L or V
  MISC_FEATURE (9)..(9): X is A and G
  MISC_FEATURE (10)..(10): X is F, W or Y for aromatic amino acids
  MISC_FEATURE (11)..(11): X is F, W or Y for aromatic amino acids
  MISC_FEATURE (12)..(12): X is K, R or H for basic amino acids
  MISC_FEATURE (13)..(13): X is F or P
  MISC_FEATURE (14)..(14): X is F or P
  MISC_FEATURE (15)..(15): X is F or P
  MISC_FEATURE (16)..(16): X is T or S
  MISC_FEATURE (17)..(17): X is K, R or H for basic amino acids
  MISC_FEATURE (18)..(18): X is I, L or V
  MISC_FEATURE (19)..(19): X is I, L or V
  MISC_FEATURE (20)..(20): X is K, R or H for basic amino acids
  MISC_FEATURE (21)..(21): X is I, L or V
XXXXXXXXXXXXXXXXXXXXX

SEQ ID NO: 578 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is N or Q for amidated amino acids
  MISC_FEATURE (3)..(3): X is A and G
  MISC_FEATURE (4)..(4): X is T or S
  MISC_FEATURE (5)..(5): X is A and G
  MISC_FEATURE (6)..(6): X is M or Nle (Norleucine)
  MISC_FEATURE (7)..(7): X is GabaX for X2X3 or X3X2 or X2X3 or X3X2 or X3X3 or X2X2
  MISC_FEATURE (8)..(8): X is A and G
  MISC_FEATURE (9)..(9): X is F, W or Y for aromatic amino acids
  MISC_FEATURE (10)..(10): X is F, W or Y for aromatic amino acids
  MISC_FEATURE (11)..(11): X is K, R or H for basic amino acids
  MISC_FEATURE (12)..(12): X is F or P
  MISC_FEATURE (13)..(13): X is F or P
  MISC_FEATURE (14)..(14): X is F or P
  MISC_FEATURE (15)..(15): X is T or S
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is K, R or H for basic amino acids
  MISC_FEATURE (20)..(20): X is I, L or V
XXXXXXXXXXXXXXXXXXXX

SEQ ID NO: 579 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is N or Q for amidated amino acids
  MISC_FEATURE (3)..(3): X is A and G
  MISC_FEATURE (4)..(4): X is T or S
  MISC_FEATURE (5)..(5): X is A and G
  MISC_FEATURE (6)..(6): X is M or Nle (Norleucine)
  MISC_FEATURE (7)..(7): X is D and E for acidic amino acids
  MISC_FEATURE (8)..(8): X is I, L or V
  MISC_FEATURE (9)..(9): X is A and G
  MISC_FEATURE (10)..(10): X is F, W or Y for aromatic amino acids
  MISC_FEATURE (11)..(11): X is F, W or Y for aromatic amino acids
  MISC_FEATURE (12)..(12): X is K, R or H for basic amino acids
  MISC_FEATURE (13)..(13): X is F or P
  MISC_FEATURE (14)..(14): X is F or P
  MISC_FEATURE (15)..(15): X is F or P
  misc_feature (16)..(16): Xaa can be any naturally occurring amino acid
  MISC_FEATURE (17)..(17): X is K, R or H for basic amino acids
  MISC_FEATURE (18)..(18): X is GabaX for X2X3 or X3X2 or X2X3 or X3X2 or X3X3 or X2X2
  MISC_FEATURE (19)..(19): X is K, R or H for basic amino acids
  MISC_FEATURE (20)..(20): X is I, l or V
XXXXXXXXXXXXXXXXXXXX

SEQ ID NO: 580 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is N or Q for amidated amino acids
  MISC_FEATURE (3)..(3): X is A and G
  MISC_FEATURE (4)..(4): X is T or S
  MISC_FEATURE (5)..(5): X is A and G
  MISC_FEATURE (6)..(6): X is M or Nle (Norleucine)
  MISC_FEATURE (7)..(7): X is GabaX for X2X3 or X3X3 or X2X3 or X3X2 or X3X3 or X2X2
  MISC_FEATURE (8)..(8): X is A and G
  MISC_FEATURE (9)..(9): X is F, W or Y for aromatic amino acids
  MISC_FEATURE (10)..(10): X is F, W or Y for aromatic amino acids
  MISC_FEATURE (11)..(11): X is F, W or Y for aromatic amino acids
  MISC_FEATURE (11)..(11): X is K, R or H for basic amino acids
  MISC_FEATURE (12)..(12): X is F or P
  MISC_FEATURE (13)..(13): X is F or P
  MISC_FEATURE (14)..(14): X is F or P
  MISC_FEATURE (15)..(15): X is T or S
  MISC_FEATURE (16)..(16): X is K, R or H for basic amino acids
  MISC_FEATURE (17)..(17): X is GabaX for X2X3 or X3X2 or X2X3 or X3X2 or X3X3 or X2X2
  MISC_FEATURE (18)..(18): X is K, R or H for basic amino acids
  MISC_FEATURE (19)..(19): X is I, L or V
XXXXXXXXXXXXXXXXXXX

SEQ ID NO: 581 - protein, 20 aa, Homo sapiens
QAPEYRGRTELLKDAIGEGK

SEQ ID NO: 582 - protein, 20 aa, Artificial
  Completely synthesized peptide construct
  MISC_FEATURE (1)..(1): X is N or Q for amidated amino acids
  MISC_FEATURE (2)..(2): X is A and G
  MISC_FEATURE (3)..(3): X is F or P
  MISC_FEATURE (4)..(4): X is D and E for acidic amino acids
  MISC_FEATURE (5)..(5): X is F, W or Y for aromatic amino acids
  MISC_FEATURE (6)..(6): X is K, R or H for basic amino acids
  MISC_FEATURE (7)..(7): X is A and G
  MISC_FEATURE (8)..(8): X is K, R or H for basic amino acids
  MISC_FEATURE (9)..(9): X is T or S
  MISC_FEATURE (10)..(10): X is D and E for acidic amino acids
  MISC_FEATURE (11)..(11): X is I, L or V
  MISC_FEATURE (12)..(12): X is I, L or V
  MISC_FEATURE (13)..(13): X is K, R or H for basic amino acids
  MISC_FEATURE (14)..(14): X is D and E for acidic amino acids
  MISC_FEATURE (15)..(15): X is A and G
  MISC_FEATURE (16)..(16): X is I, L or V
  MISC_FEATURE (17)..(17): X is A and G
  MISC_FEATURE (18)..(18): X is D and E for acidic amino acids
  MISC_FEATURE (19)..(19): X is A and G
  MISC_FEATURE (20)..(20): X is K, R or H for basic amino acids
XXXXXXXXXXXXXXXXXXXX

SEQ ID NO: 583 - protein, 19 aa, Artificial
  Completely synthesized peptide construct
  MISC_FEATURE (1)..(1): X is N or Q for amidated amino acids
  MISC_FEATURE (2)..(2): X is A and G
  MISC_FEATURE (3)..(3): X is F or P
  MISC_FEATURE (4)..(4): X is D and E for acidic amino acids
  MISC_FEATURE (5)..(5): X is F, W or Y for aromatic amino acids
  MISC_FEATURE (6)..(6): X is K, R or H for basic amino acids
  MISC_FEATURE (7)..(7): X is A and G
  MISC_FEATURE (8)..(8): X is K, R or H for basic amino acids
  MISC_FEATURE (9)..(9): X is T or S
  MISC_FEATURE (10)..(10): X is GabaX for X2X3 or X3X2 or X2X3 orX3X2 or X3X3 or X2X2
  MISC_FEATURE (11)..(11): X is I, L or V
  MISC_FEATURE (12)..(12): X is K, R or H for basic amino acids
  MISC_FEATURE (13)..(13): X is D and E for acidic amino acids
  MISC_FEATURE (14)..(14): X is A and G
  MISC_FEATURE (15)..(15): X is I, L or V
  MISC_FEATURE (16)..(16): X is A and G
  MISC_FEATURE (17)..(17): X is D and E for acidic amino acids
  MISC_FEATURE (18)..(18): X is A and G
  MISC_FEATURE (19)..(19): X is K, R or H for basic amino acids
XXXXXXXXXXXXXXXXXXX

SEQ ID NO: 584 - protein, 18 aa, Artificial
  Completely synthesized peptide construct
  MISC_FEATURE (1)..(1): X is N or Q for amidated amino acids
  MISC_FEATURE (2)..(2): X is A and G
  MISC_FEATURE (3)..(3): X is F or P
  MISC_FEATURE (4)..(4): X is D and E for acidic amino acids
  MISC_FEATURE (5)..(5): X is F, W or Y for aromatic amino acids
  MISC_FEATURE (6)..(6): X is K, R or H for basic amino acids
  MISC_FEATURE (7)..(7): X is A and G
  MISC_FEATURE (8)..(8): X is K, R or H for basic amino acids
  MISC_FEATURE (9)..(9): X is T or S
  MISC_FEATURE (10)..(10): X is 5-aminopentanoic acid for replacement of 3 or 4 amino acids of X2 and X3
  MISC_FEATURE (11)..(11): X is K, R or H for basic amino acids
  MISC_FEATURE (12)..(12): X is D and E for acidic amino acids
  MISC_FEATURE (13)..(13): X is A and G
  MISC_FEATURE (14)..(14): X is I, L or V
  MISC_FEATURE (15)..(15): X is A and G
  MISC_FEATURE (16)..(16): X is A and G
  MISC_FEATURE (16)..(16): X is D and E for acidic amino acids
  MISC_FEATURE (17)..(17): X is A and G
  MISC_FEATURE (18)..(18): X is K, R or H for basic amino acids
XXXXXXXXXXXXXXXXXX

SEQ ID NO: 585 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is N or Q for amidated amino acids
  MISC_FEATURE (3)..(3): X is A and G
  MISC_FEATURE (4)..(4): X is F or P
  MISC_FEATURE (5)..(5): X is D and E for acidic amino acids
  MISC_FEATURE (6)..(6): X is F, W or Y for aromatic amino acids
  MISC_FEATURE (7)..(7): X is K, R or H for basic amino acids
  MISC_FEATURE (8)..(8): X is A and G
  MISC_FEATURE (9)..(9): X is K, R or H for basic amino acids
  MISC_FEATURE (10)..(10): X is T or S
  MISC_FEATURE (11)..(11): X is D and E for acidic amino acids
  MISC_FEATURE (12)..(12): X is I, L or V
  MISC_FEATURE (13)..(13): X is I, L or V
  MISC_FEATURE (14)..(14): X is K, R or H for basic amino acids
  MISC_FEATURE (15)..(15): X is D and E for acidic amino acids
  MISC_FEATURE (16)..(16): X is A and G
  MISC_FEATURE (17)..(17): X is I, L or V
  MISC_FEATURE (18)..(18): X is A and G
  MISC_FEATURE (19)..(19): X is D and E for acidic amino acids
  MISC_FEATURE (20)..(20): X is A and G
  MISC_FEATURE (21)..(21): X is K, R or H for basic amino acids
XXXXXXXXXXXXXXXXXXXXX

SEQ ID NO: 586 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is N or Q for amidated amino acids
  MISC_FEATURE (3)..(3): X is A and G
  MISC_FEATURE (4)..(4): X is F or P
  MISC_FEATURE (5)..(5): X is D and E for acidic amino acids
  MISC_FEATURE (6)..(6): X is F, W or Y for aromatic amino acids
  MISC_FEATURE (7)..(7): X is K, R or H for basic amino acids
  MISC_FEATURE (8)..(8): X is A and G
  MISC_FEATURE (9)..(9): X is K, R or H for basic amino acids
  MISC_FEATURE (10)..(10): X is T or S
  MISC_FEATURE (11)..(11): X is GabaX for X2X3 or X3X2 or X2X3 or X3X2 or X3X3 or X2X2
  MISC_FEATURE (12)..(12): X is  I, L or V
  MISC_FEATURE (13)..(13): X is K, R or H for basic amino acids
  MISC_FEATURE (14)..(14): X is D and E for acidic amino acids
  MISC_FEATURE (15)..(15): X is A and G
  MISC_FEATURE (16)..(16): X is I, L or V
  MISC_FEATURE (17)..(17): X is A and G
  MISC_FEATURE (18)..(18): X is D and E for acidic amino acids
  MISC_FEATURE (19)..(19): X is A and G
  MISC_FEATURE (20)..(20): X is K, R or H for basic amino acids
XXXXXXXXXXXXXXXXXXXX

SEQ ID NO: 587 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is N or Q for amidated amino acids
  MISC_FEATURE (3)..(3): X is A and G
  MISC_FEATURE (4)..(4): X is F or P
  MISC_FEATURE (5)..(5): X is D and E for acidic amino acids
  MISC_FEATURE (6)..(6): X is F, W or Y for aromatic amino acids
  MISC_FEATURE (7)..(7): X is K, R or H for basic amino acids
  MISC_FEATURE (8)..(8): X is A and G
  MISC_FEATURE (9)..(9): X is K, R or H for basic amino acids
  MISC_FEATURE (10)..(10): X is T or S
  MISC_FEATURE (11)..(11): X is 5-aminopentanoic acid for replacement of 3 or 4 amino acids of X2and X3
  MISC_FEATURE (12)..(12): X is K, R or H for basic amino acids
  MISC_FEATURE (13)..(13): X is D and E for acidic amino acids
  MISC_FEATURE (14)..(14): X is A and G
  MISC_FEATURE (15)..(15): X is I, L or V
  MISC_FEATURE (16)..(16): X is A and G
  MISC_FEATURE (17)..(17): X is D and E for acidic amino acids
  MISC_FEATURE (18)..(18): X is A and G
  MISC_FEATURE (19)..(19): X is K, R or H for basic amino acids
XXXXXXXXXXXXXXXXXXX

SEQ ID NO: 588 - protein, 20 aa, Homo sapiens
SDEGGFTCFFRDHSYQEEAA

SEQ ID NO: 589 - protein, 20 aa, Artificial
  Completely synthesized peptide construct
  MISC_FEATURE (1)..(1): X is T or S
  MISC_FEATURE (2)..(2): X is D and E for acidic amino acids
  MISC_FEATURE (3)..(3): X is A and G
  MISC_FEATURE (4)..(4): X is A and G
  MISC_FEATURE (5)..(5): X is A and G
  MISC_FEATURE (6)..(6): X is T or S
  MISC_FEATURE (7)..(7): X is T or S
  MISC_FEATURE (8)..(8): X is C or S
  MISC_FEATURE (9)..(9): X is F or P
  MISC_FEATURE (10)..(10): X is F or P
  MISC_FEATURE (11)..(11): X is K, R or H for basic amino acids
  MISC_FEATURE (12)..(12): X is D and E for acidic amino acids
  MISC_FEATURE (13)..(13): X is K, R or H for basic amino acids
  MISC_FEATURE (14)..(14): X is T or S
  MISC_FEATURE (15)..(15): X is F, W or Y for aromatic amino acids
  MISC_FEATURE (16)..(16): X is N or Q for amidated amino acids
  MISC_FEATURE (17)..(17): X is D and E for acidic amino acids
  MISC_FEATURE (18)..(18): X is D and E for acidic amino acids
  MISC_FEATURE (19)..(19): X is A and G
  MISC_FEATURE (20)..(20): X is A and G
XXXXXXXXXXXXXXXXXXXX

SEQ ID NO: 590 - protein, 19 aa, Artificial
  Completely synthesized peptide construct
  MISC_FEATURE (1)..(1): X is T or S
  MISC_FEATURE (2)..(2): X is GabaX for X2X3 or X3X2 or X2X3 or X3X2 or X3X3 or X2X2
  MISC_FEATURE (3)..(3): X is A and G
  MISC_FEATURE (4)..(4): X is A and G
  MISC_FEATURE (5)..(5): X is F or P
  MISC_FEATURE (6)..(6): X is T or S
  MISC_FEATURE (7)..(6): X is C or S
  misc_feature (7)..(7): Xaa can be any naturally occurring amino acid
  MISC_FEATURE (8)..(8): X is F or P
  MISC_FEATURE (9)..(9): X is F or P
  MISC_FEATURE (10)..(10): X is K, R or H for basic amino acids
  MISC_FEATURE (11)..(11): X is D and E for acidic amino acids
  MISC_FEATURE (12)..(12): X is K, R or H for basic amino acids
  MISC_FEATURE (13)..(13): X is T or S
  MISC_FEATURE (14)..(14): X is F, W for Y for aromatic amino acids
  MISC_FEATURE (15)..(15): X is N or Q for amidated amino acids
  MISC_FEATURE (16)..(16): X is D and E for acidic amino acids
  MISC_FEATURE (17)..(17): X is D and E for acidic amino acids
  MISC_FEATURE (18)..(18): X is A and G
  MISC_FEATURE (19)..(19): X is A and G
XXXXXXXXXXXXXXXXXXX

SEQ ID NO: 591 - protein, 19 aa, Artificial
  Completely synthesized peptide construct
  MISC_FEATURE (1)..(1): X is T or S
  MISC_FEATURE (2)..(2): X is D and E for acidic amino acids
  MISC_FEATURE (3)..(3): X is D and E for acidic amino acids
  MISC_FEATURE (4)..(4): X is A and G
  MISC_FEATURE (5)..(5): X is A and G
  MISC_FEATURE (6)..(6): X is F or P
  MISC_FEATURE (7)..(7): X is T or S
  MISC_FEATURE (8)..(8): X is C or S
  MISC_FEATURE (9)..(9): X is F or P
  MISC_FEATURE (10)..(10): X is F or P
  MISC_FEATURE (11)..(11): X is K, R or H for basic amino acids
  MISC_FEATURE (12)..(12): X is D and E for acidic amino acids
  MISC_FEATURE (13)..(13): X is K, R or H for basic amino acids
  MISC_FEATURE (14)..(14): X is T or S
  MISC_FEATURE (15)..(15): X is F, W or Y for aromatic amino acids
  MISC_FEATURE (16)..(16): X is N or Q for amidated amino acids
  MISC_FEATURE (17)..(17): X is GabaX for X2X3 or X3X2 or X2X3 or X3X2 or X3X3 or X2X2
  MISC_FEATURE (18)..(18): X is A and G
  MISC_FEATURE (19)..(19): X is A and G
XXXXXXXXXXXXXXXXXXX

SEQ ID NO: 592 - protein, 18 aa, Artificial
  Completely synthesized peptide construct
  MISC_FEATURE (1)..(1): X is T or S
  MISC_FEATURE (2)..(2): X is GabaX for X2X3 or X3X2 or X2X3 or X3X2 or X3X3 or X2X2
  MISC_FEATURE (3)..(3): X is A and G
  MISC_FEATURE (4)..(4): X is A and G
  MISC_FEATURE (5)..(5): X is F or P
  MISC_FEATURE (6)..(6): X is T or S
  MISC_FEATURE (7)..(7): X is C or S
  MISC_FEATURE (8)..(8): X is F or P
  MISC_FEATURE (9)..(9): X is F or P
  MISC_FEATURE (10)..(10): X is K, R or H for basic amino acids
  MISC_FEATURE (11)..(11): X is D and E for acidic amino acids
  MISC_FEATURE (12)..(12): X is K, R or H for basic amino acids
  MISC_FEATURE (13)..(13): X is T or S
  MISC_FEATURE (14)..(14): X is F, W or Y for aromatic amino acids
  MISC_FEATURE (15)..(15): X is N or Q for amidated amino acids
  MISC_FEATURE (16)..(16): X is GabaX for X2X3 or X3X2 or X2X3 or X3X2 or X3X3 or X2X2
  MISC_FEATURE (17)..(17): X is A and G
  MISC_FEATURE (18)..(18): X is A and G
XXXXXXXXXXXXXXXXXX

SEQ ID NO: 593 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is D and E for acidic amino acids
  MISC_FEATURE (4)..(4): X is D and E for acidic amino acids
  MISC_FEATURE (5)..(5): X is A and G
  MISC_FEATURE (6)..(6): X is A and G
  MISC_FEATURE (7)..(7): X is F or P
  MISC_FEATURE (8)..(8): X is T or S
  MISC_FEATURE (9)..(9): X is C or S
  MISC_FEATURE (10)..(10): X is F or P
  MISC_FEATURE (11)..(11): X is F or P
  MISC_FEATURE (12)..(12): X is K, R or H for basic amino acids
  MISC_FEATURE (13)..(13): X is D and E for acidic amino acids
  MISC_FEATURE (14)..(14): X is K, R or H for basic amino acids
  MISC_FEATURE (15)..(15): X is T or S
  MISC_FEATURE (16)..(16): X is F, W or Y for aromatic amino acids
  MISC_FEATURE (17)..(17): X is N or Q for amidated amino acids
  MISC_FEATURE (18)..(18): X is D and E for acidic amino acids
  MISC_FEATURE (19)..(19): X is D and E for acidic amino acids
  MISC_FEATURE (20)..(20): X is A and G
  MISC_FEATURE (21)..(21): X is A and G
XXXXXXXXXXXXXXXXXXXXX

SEQ ID NO: 594 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is GabaX for X2X3 or X3X2 or X2X3 or X3X2 or X3X3 or X2X2
  MISC_FEATURE (4)..(4): X is A and G
  MISC_FEATURE (5)..(5): X is A and G
  MISC_FEATURE (6)..(6): X is F or P
  MISC_FEATURE (7)..(7): X is T or S
  MISC_FEATURE (8)..(8): X is C or S
  MISC_FEATURE (9)..(9): X is F or P
  MISC_FEATURE (10)..(10): X is F or P
  MISC_FEATURE (11)..(11): X is K, R or H for basic amino acids
  MISC_FEATURE (12)..(12): X is D and E for acidic amino acids
  MISC_FEATURE (13)..(13): X is K, R or H for basic amino acids
  MISC_FEATURE (14)..(14): X is T or S
  MISC_FEATURE (15)..(15): X is F, W or Y for aromatic amino acids
  MISC_FEATURE (16)..(16): X is N or Q for amidated amino acids
  MISC_FEATURE (17)..(17): X is D and E for acidic amino acids
  MISC_FEATURE (18)..(18): X is D and E for acidic amino acids
  MISC_FEATURE (19)..(19): X is A and G
  MISC_FEATURE (20)..(20): X is A and G
XXXXXXXXXXXXXXXXXXXX

SEQ ID NO: 595 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is D and E for acidic amino acids
  MISC_FEATURE (4)..(4): X is D and E for acidic amino acids
  MISC_FEATURE (5)..(5): X is A and G
  MISC_FEATURE (6)..(6): X is A and G
  MISC_FEATURE (7)..(7): X is F or P
  MISC_FEATURE (8)..(8): X is T or S
  MISC_FEATURE (9)..(9): X is C or S
  MISC_FEATURE (10)..(10): X is F or P
  MISC_FEATURE (11)..(11): X is F or P
  MISC_FEATURE (12)..(12): X is K, R or H for basic amino acids
  MISC_FEATURE (13)..(13): X is D and E for acidic amino acids
  MISC_FEATURE (14)..(14): X is K, R or H for basic amino acids
  MISC_FEATURE (15)..(15): X is T or S
  MISC_FEATURE (16)..(16): X is F, W or Y for aromatic amino acids
  MISC_FEATURE (17)..(17): X is N or Q for amidated amino acids
  MISC_FEATURE (18)..(18): X is GabaX for X2X3 or X3X2 or X2X3 or X3X2 or X3X3 or X2X2
  MISC_FEATURE (19)..(19): X is A and G
  MISC_FEATURE (20)..(20): X is A and G
XXXXXXXXXXXXXXXXXXXX

SEQ ID NO: 596 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is GabaX for X2X3 or X3X2 or X2X3 or X3X2 or X3X3 or X2X2
  MISC_FEATURE (4)..(4): X is A and G
  MISC_FEATURE (5)..(5): X is A and G
  MISC_FEATURE (6)..(6): X is F or P
  MISC_FEATURE (7)..(7): X is T or S
  MISC_FEATURE (8)..(8): X is C or S
  MISC_FEATURE (9)..(9): X is F or P
  MISC_FEATURE (10)..(10): X is F or P
  MISC_FEATURE (11)..(11): X is K, R or H for basic amino acids
  MISC_FEATURE (12)..(12): X is D and E for acidic amino acids
  MISC_FEATURE (13)..(13): X is K, R or H for basic amino acids
  MISC_FEATURE (14)..(14): X is T or S
  MISC_FEATURE (15)..(15): X is F, W or Y for aromatic amino acids
  MISC_FEATURE (16)..(16): X is N or Q for amidated amino acids
  MISC_FEATURE (17)..(17): X is GabaX for X2X3 or X3X2 or X2X3 or X3X2 or X3X3 or X2X2
  MISC_FEATURE (18)..(18): X is A andG
  MISC_FEATURE (19)..(19): X is A andG
XXXXXXXXXXXXXXXXXXX

SEQ ID NO: 597 - protein, 15 aa, Homo sapiens
ENPVVHFFKNIVTPR

SEQ ID NO: 598 - protein, 15 aa, Artificial
  Completely synthesized peptide construct
  MISC_FEATURE (1)..(1): X is D and E for acidic amino acids
  MISC_FEATURE (2)..(2): X is N or Q for amidated amino acids
  MISC_FEATURE (3)..(3): X is F or P
  MISC_FEATURE (4)..(4): X is I, L or V
  MISC_FEATURE (5)..(5): X is I, L or V
  MISC_FEATURE (6)..(6): X is K, R or H for basic amino acids
  MISC_FEATURE (7)..(7): X is F, W or Y for aromatic amino acids
  MISC_FEATURE (8)..(8): X is F, W or Y for aromatic amino acids
  MISC_FEATURE (9)..(9): X is K, R or H for basic amino acids
  MISC_FEATURE (10)..(10): X is N or Q for amidated amino acids
  MISC_FEATURE (11)..(11): X is I, L or V
  MISC_FEATURE (12)..(12): X is I, L or V
  MISC_FEATURE (13)..(13): X is T or S
  MISC_FEATURE (14)..(14): X is F or P
  MISC_FEATURE (15)..(15): X is K, R or H for basic amino acids
XXXXXXXXXXXXXXX

SEQ ID NO: 599 - protein, 14 aa, Artificial
  Completely synthesized peptide construct
  MISC_FEATURE (1)..(1): X is D and E for acidic amino acids
  MISC_FEATURE (2)..(2): X is N or Q for amidated amino acids
  MISC_FEATURE (3)..(3): X is F or P
  MISC_FEATURE (4)..(4): X is GabaX for X2X3 or X3X2 or X2X3 or X3X2 or X3X3 or X2X2
  MISC_FEATURE (5)..(5): X is K, R or H for basic amino acids
  MISC_FEATURE (6)..(6): X is F, W or Y for aromatic amino acids
  MISC_FEATURE (7)..(7): X is F, W or Y for aromatic amino acids
  MISC_FEATURE (8)..(8): X is K, R or H for basic amino acids
  MISC_FEATURE (9)..(9): X is N or Q for amidated amino acids
  MISC_FEATURE (10)..(10): X is I, L or V
  MISC_FEATURE (11)..(11): X is I, L or V
  MISC_FEATURE (12)..(12): X is T or S
  MISC_FEATURE (13)..(13): X is F or P
  MISC_FEATURE (14)..(14): X is K, R or H for basic amino acids
XXXXXXXXXXXXXX

SEQ ID NO: 600 - protein, 14 aa, Artificial
  Completely synthesized peptide construct
  MISC_FEATURE (1)..(1): X is D and E for acidic amino acids
  MISC_FEATURE (2)..(2): X is N or Q for amidated amino acids
  MISC_FEATURE (3)..(3): X is F or P
  MISC_FEATURE (4)..(4): X is I, L or V
  MISC_FEATURE (5)..(5): X is I, L or V
  MISC_FEATURE (6)..(6): X is K, R or H for basic amino acids
  MISC_FEATURE (7)..(7): X is K, R or H for basic amino acids
  MISC_FEATURE (8)..(8): X is K, R or H for basic amino acids
  MISC_FEATURE (9)..(9): X is N or Q for amidated amino acids
  MISC_FEATURE (9)..(9): X is K, R or H for basic amino acids
  MISC_FEATURE (10)..(10): X is N or Q for amidated amino acids
  MISC_FEATURE (11)..(11): X is GabaX for X2X3 or X3X2 or X2X3 or X3X2 or X3X3 or X2X2
  MISC_FEATURE (12)..(12): X is T or S
  MISC_FEATURE (13)..(13): X is F or P
  MISC_FEATURE (14)..(14): X is K, R or H for basic amino acids
XXXXXXXXXXXXXX

SEQ ID NO: 601 - protein, 13 aa, Artificial
  Completely synthesized peptide construct
  MISC_FEATURE (1)..(1): X is D and E for acidic amino acids
  MISC_FEATURE (2)..(2): X is N or Q for amidated amino acids
  MISC_FEATURE (3)..(3): X is F or P
  MISC_FEATURE (4)..(4): X is GabaX for X2X3 or X3X2 or X2X3 or X3X2 or X3X3 or X2X2
  MISC_FEATURE (5)..(5): X is K, R or H for basic amino acids
  MISC_FEATURE (6)..(6): X is F, W or Y for aromatic amino acids
  MISC_FEATURE (7)..(7): X is F, W or Y for aromatic amino acids
  MISC_FEATURE (8)..(8): X is K, R or H for basic amino acids
  MISC_FEATURE (9)..(9): X is N or Q for amidated amino acids
  MISC_FEATURE (10)..(10): X is GabaX for X2X3 or X3X2 or X2X3 or X3X2 or X3X3 or X2X2
  MISC_FEATURE (11)..(11): X is T or S
  MISC_FEATURE (12)..(12): X is F or P
  MISC_FEATURE (13)..(13): X is K, R or H for basic amino acids
XXXXXXXXXXXXX

SEQ ID NO: 602 - protein, 16 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is N or Q for amidated amino acids
  MISC_FEATURE (4)..(4): X is F or P
  MISC_FEATURE (5)..(5): X is I, L or V
  MISC_FEATURE (6)..(6): X is I, L or V
  MISC_FEATURE (7)..(7): X is K, R or H for basic amino acids
  MISC_FEATURE (8)..(8): X is F, W or Y for aromatic amino acids
  MISC_FEATURE (9)..(9): X is F, W or Y for aromatic amino acids
  MISC_FEATURE (10)..(10): X is K, R or H for basic amino acids
  MISC_FEATURE (11)..(11): X is N or Q for amidated amino acids
  MISC_FEATURE (12)..(12): X is I, L or V
  MISC_FEATURE (13)..(13): X is I, L or V
  MISC_FEATURE (14)..(14): X is T or S
  MISC_FEATURE (15)..(15): X is F or P
  MISC_FEATURE (16)..(16): X is K, R or H for basic amino acids
XXXXXXXXXXXXXXXX

SEQ ID NO: 603 - protein, 15 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is N or Q for amidated amino acids
  MISC_FEATURE (4)..(4): X is F or P
  MISC_FEATURE (5)..(5): X is GabaX for X2X3 or X3X2 or X2X3 or X3X2 or X3X3 or X2X2
  MISC_FEATURE (6)..(6): X is K, R or H for basic amino acids
  MISC_FEATURE (7)..(7): X is F, W or Y for aromatic amino acids
  MISC_FEATURE (8)..(8): X is F, W or Y for aromatic amino acids
  MISC_FEATURE (9)..(9): X is K, R or H for basic amino acids
  MISC_FEATURE (10)..(10): X is N or Q for amidated amino acids
  MISC_FEATURE (11)..(11): X is I, L or V
  MISC_FEATURE (12)..(12): X is I, L or V
  MISC_FEATURE (13)..(13): X is T or S
  MISC_FEATURE (14)..(14): X is F or P
  MISC_FEATURE (15)..(15): X is K, R or H for basic amino acids
XXXXXXXXXXXXXXX

SEQ ID NO: 604 - protein, 15 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is N or Q for amidated amino acids
  MISC_FEATURE (4)..(4): X is F or P
  MISC_FEATURE (5)..(5): X is I, L or V
  MISC_FEATURE (6)..(6): X is I, L or V
  MISC_FEATURE (7)..(7): X is K, R or H for basic amino acids
  MISC_FEATURE (8)..(8): X is F, W or Y for aromatic amino acids
  MISC_FEATURE (9)..(9): X is F, W or Y for aromatic amino acids
  MISC_FEATURE (10)..(10): X is K, R or H for basic amino acids
  MISC_FEATURE (11)..(11): X is N or Q for amidated amino acids
  MISC_FEATURE (12)..(12): X is GabaX for X2X3 or X3X2 or X2X3 or X3X2 or X3X3 or X2X2
  MISC_FEATURE (13)..(13): X is T or S
  MISC_FEATURE (14)..(14): X is F or P
  MISC_FEATURE (15)..(15): X is K, R or H for basic amino acids
XXXXXXXXXXXXXXX

SEQ ID NO: 605 - protein, 14 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is N or Q for amidated amino acids
  MISC_FEATURE (4)..(4): X is F or P
  MISC_FEATURE (5)..(5): X is GabaX for X2X3 or X3X2 or X2X3 or X3X2 or X3X3 or X2X2
  MISC_FEATURE (6)..(6): X is K, R or H for basic amino acids
  MISC_FEATURE (7)..(7): X is F, W or Y for aromatic amino acids
  MISC_FEATURE (8)..(8): X is F, W or Y for aromatic amino acids
  MISC_FEATURE (9)..(9): X is K, R or H for basic amino acids
  MISC_FEATURE (10)..(10): X is N or Q for amidated amino acids
  MISC_FEATURE (11)..(11): X is GabaX for X2X3 or X3X2 or X2X3 or X3X2 or X3X3 or X2X2
  MISC_FEATURE (12)..(12): X is T or S
  MISC_FEATURE (13)..(13): X is F or P
  MISC_FEATURE (14)..(14): X is K, R or H for basic amino acids
XXXXXXXXXXXXXX

SEQ ID NO: 606 - protein, 16 aa, Homo sapiens
QSIAFPSKTSASIGSL

SEQ ID NO: 607 - protein, 16 aa, Artificial
  Completely synthesized peptide construct
  MISC_FEATURE (1)..(1): X is N or Q for amidated amino acids
  MISC_FEATURE (2)..(2): X is T or S
  MISC_FEATURE (3)..(3): X is I, L or V
  MISC_FEATURE (4)..(4): X is A and G
  MISC_FEATURE (5)..(5): X is GabaX for X2X3 or X3X2 or X2X3 or X3X2 or X3X3 or X2X2
  MISC_FEATURE (6)..(6): X is F or P
  MISC_FEATURE (7)..(7): X is T or S
  MISC_FEATURE (8)..(8): X is K, R or H for basic amino acids
  MISC_FEATURE (9)..(9): X is T or S
  MISC_FEATURE (10)..(10): X is T or S
  MISC_FEATURE (11)..(11): X is A and G
  MISC_FEATURE (12)..(12): X is T or S
  MISC_FEATURE (13)..(13): X is I, L or V
  MISC_FEATURE (14)..(14): X is A and G
  MISC_FEATURE (15)..(15): X is T or S
  MISC_FEATURE (16)..(16): X is I, L or V
XXXXXXXXXXXXXXXX

SEQ ID NO: 608 - protein, 17 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is N or Q for amidated amino acids
  MISC_FEATURE (3)..(3): X is T or S
  MISC_FEATURE (4)..(4): X is I, L or V
  MISC_FEATURE (5)..(5): X is A and G
  MISC_FEATURE (6)..(6): X is F or P
  MISC_FEATURE (7)..(7): X is F or P
  MISC_FEATURE (8)..(8): X is T or S
  MISC_FEATURE (9)..(9): X is K, R or H for basic amino acids
  MISC_FEATURE (10)..(10): X is T or S
  MISC_FEATURE (11)..(11): X is T or S
  MISC_FEATURE (12)..(12): X is A and G
  MISC_FEATURE (13)..(13): X is T or S
  MISC_FEATURE (14)..(14): X is I, L or V
  MISC_FEATURE (15)..(15): X is A and G
  MISC_FEATURE (16)..(16): X is T or S
  MISC_FEATURE (17)..(17): X is I, L or V
XXXXXXXXXXXXXXXXX

SEQ ID NO: 609 - protein, 20 aa, Homo  sapiens
SKTSASIGSLCADARMYGVL

SEQ ID NO: 610 - protein, 19 aa, Artificial
  Completely synthesized peptide construct
  MISC_FEATURE (1)..(1): X is T or S
  MISC_FEATURE (2)..(2): X is K, R or H for basic amino acids
  MISC_FEATURE (3)..(3): X is T or S
  MISC_FEATURE (4)..(4): X is T or S
  MISC_FEATURE (5)..(5): X is A and G
  MISC_FEATURE (6)..(6): X is T or S
  MISC_FEATURE (7)..(7): X is I, L or V
  MISC_FEATURE (8)..(8): X is A and G
  MISC_FEATURE (9)..(9): X is T or S
  MISC_FEATURE (10)..(10): X is I, L or V
  MISC_FEATURE (11)..(11): X is C or S
  MISC_FEATURE (12)..(12): X is A and G
  MISC_FEATURE (13)..(13): X is D and E for acidic amino acids
  MISC_FEATURE (14)..(14): X is A and G
  MISC_FEATURE (15)..(15): X is K, R or H for basic amino acids
  MISC_FEATURE (16)..(16): X is M or Nle (Norleucine)
  MISC_FEATURE (17)..(17): X is F, W or Y for aromatic amino acids
  MISC_FEATURE (18)..(18): X is A and G
  MISC_FEATURE (19)..(19): X is I, L or V
XXXXXXXXXXXXXXXXXXX

SEQ ID NO: 611 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is K, R or H for basic amino acids
  MISC_FEATURE (4)..(4): X is T or S
  MISC_FEATURE (5)..(5): X is T or S
  MISC_FEATURE (6)..(6): X is A and G
  MISC_FEATURE (7)..(7): X is T or S
  MISC_FEATURE (8)..(8): X is I, L or V
  MISC_FEATURE (9)..(9): X is A and G
  MISC_FEATURE (10)..(10): X is T or S
  MISC_FEATURE (11)..(11): X is I, L or V
  MISC_FEATURE (12)..(12): X is C or S
  MISC_FEATURE (13)..(13): X is A and G
  MISC_FEATURE (14)..(14): X is D and E for acidic amino acids
  MISC_FEATURE (15)..(15): X is A and G
  MISC_FEATURE (16)..(16): X is K, R or H for basic amino acids
  MISC_FEATURE (17)..(17): X is M or Nle (Norleucine)
  MISC_FEATURE (18)..(18): X is F, W or Y for aromatic amino acids
  MISC_FEATURE (19)..(19): X is A and G
  MISC_FEATURE (20)..(20): X is I, L or V
XXXXXXXXXXXXXXXXXXXX

SEQ ID NO: 612 - protein, 9 aa, Homo sapiens
FFRDHSYQE

SEQ ID NO: 613 - protein, 9 aa, Artificial
  Completely synthesized peptide construct
  MISC_FEATURE (1)..(1): X is F or P
  MISC_FEATURE (2)..(2): X is F or P
  MISC_FEATURE (3)..(3): X is K, R or H for basic amino acids
  MISC_FEATURE (4)..(4): X is D and E for acidic amino acids
  MISC_FEATURE (5)..(5): X is K, R or H for basic amino acids
  MISC_FEATURE (6)..(6): X is T or S
  MISC_FEATURE (7)..(7): X is F, W or Y for aromatic amino acids
  MISC_FEATURE (8)..(8): X is N or Q for amidated amino acids
  MISC_FEATURE (9)..(9): X is D and E for acidic amino acids
XXXXXXXXX

SEQ ID NO: 614 - protein, 10 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is F or P
  MISC_FEATURE (3)..(3): X is F or P
  MISC_FEATURE (4)..(4): X is K, R or H for basic amino acids
  MISC_FEATURE (5)..(5): X is D and E for acidic amino acids
  MISC_FEATURE (6)..(6): X is K, R or H for basjc amino acids
  MISC_FEATURE (7)..(7): X is T or S
  MISC_FEATURE (8)..(8): X is F, W or Y for aromatic amino acids
  MISC_FEATURE (9)..(9): X is N or Q for amidated amino acids
  MISC_FEATURE (10)..(10): X is D and E for acidic amino acids
XXXXXXXXXX

SEQ ID NO: 615 - protein, 14 aa, Artificial
  Completely synthesized peptide construct
  MISC_FEATURE (1)..(1): X is D and E for acidic amino acids
  MISC_FEATURE (2)..(2): X is N or Q for amidated amino acids
  MISC_FEATURE (3)..(3): X is F or P
  MISC_FEATURE (4)..(4): X is I, L or V
  MISC_FEATURE (5)..(5): X is I, L or V
  MISC_FEATURE (6)..(6): X is K, R or H for basic amino acids
  MISC_FEATURE (7)..(7): X is F or P
  MISC_FEATURE (8)..(8): X is F or P
  MISC_FEATURE (9)..(9): X is K, R or H for basic amino acids
  MISC_FEATURE (10)..(10): X is N or Q for amidated amino acids
  MISC_FEATURE (11)..(11): X is I, L or V
  MISC_FEATURE (12)..(12): X is I, L or V
  MISC_FEATURE (13)..(13): X is T or S
  MISC_FEATURE (14)..(14): X is F or P
XXXXXXXXXXXXXX

SEQ ID NO: 616 - protein, 13 aa, Artificial
  Completely synthesized peptide construct
  MISC_FEATURE (1)..(1): X is D and E for acidic amino acids
  MISC_FEATURE (2)..(2): X is N or Q for amidated amino acids
  MISC_FEATURE (3)..(3): X is F or P
  MISC_FEATURE (4)..(4): X is GabaX for X2X3 or X3X2 or X2X3 or X3X2 or X3X3 or X2X2
  MISC_FEATURE (5)..(5): X is K, R or H for basic amino acids
  MISC_FEATURE (6)..(6): X is F or P
  MISC_FEATURE (7)..(7): X is F or P
  MISC_FEATURE (8)..(8): X is K, R or H for basic amino acids
  MISC_FEATURE (9)..(9): X is N or Q for amidated amino acids
  MISC_FEATURE (10)..(10): X is I, L or V
  MISC_FEATURE (11)..(11): X is I, L or V
  MISC_FEATURE (12)..(12): X is T or S
  MISC_FEATURE (13)..(13): X is F or P
XXXXXXXXXXXXX

SEQ ID NO: 617 - protein, 13 aa, Artificial
  Completely synthesized peptide construct
  MISC_FEATURE (1)..(1): X is D and E for acidic amino acids
  MISC_FEATURE (2)..(2): X is N or Q for amidated amino acids
  MISC_FEATURE (3)..(3): X is F or P
  MISC_FEATURE (4)..(4): X is I, L or V
  MISC_FEATURE (5)..(5): X is I, L or V
  MISC_FEATURE (6)..(6): X is K, R or H for basic amino acids
  MISC_FEATURE (7)..(7): X is F or P
  MISC_FEATURE (8)..(8): X is F or P
  MISC_FEATURE (9)..(9): X is K, R or H for basic amino acids
  MISC_FEATURE (10)..(10): X is N or Q for amidated amino acids
  MISC_FEATURE (11)..(11): X is GabaX for X2X3 or X3X2 or X2X3 or X3X2 or X3X3 or X2X2
  MISC_FEATURE (12)..(12): X is T or S
  MISC_FEATURE (13)..(13): X is F or P
XXXXXXXXXXXXX

SEQ ID NO: 618 - protein, 12 aa, Artificial
  Completely synthesized peptide construct
  MISC_FEATURE (1)..(1): X is D and E for acidic amino acids
  MISC_FEATURE (2)..(2): X is N or Q for amidated amino acids
  MISC_FEATURE (3)..(3): X is F or P
  MISC_FEATURE (4)..(4): X is GabaX for X2X3 or X3X2 or X2X3 or X3X2 or X3X3 or X2X2
  MISC_FEATURE (5)..(5): X is K, R or H for basic amino acids
  MISC_FEATURE (6)..(6): X is F or P
  MISC_FEATURE (7)..(7): X is F or P
  MISC_FEATURE (8)..(8): X is K, R or H for basic amino acids
  MISC_FEATURE (9)..(9): X is N or Q for amidated amino acids
  MISC_FEATURE (10)..(10): X is GabaX for X2X3 or X3X2 or X2X3 or X3X2 or X3X3 or X2X2
  MISC_FEATURE (11)..(11): X is T or S
  MISC_FEATURE (12)..(12): X is F or P
XXXXXXXXXXXX

SEQ ID NO: 619 - protein, 15 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is N or Q for amidated amino acids
  MISC_FEATURE (4)..(4): X is F or P
  MISC_FEATURE (5)..(5): X is I, L or V
  MISC_FEATURE (6)..(6): X is I, L or V
  MISC_FEATURE (7)..(7): X is K, R or H for basic amino acids
  MISC_FEATURE (8)..(8): X is F or P
  MISC_FEATURE (9)..(9): X is F or P
  MISC_FEATURE (10)..(10): X is K, R or H for basic amino acids
  MISC_FEATURE (11)..(11): X is N or Q for amidated amino acids
  MISC_FEATURE (12)..(12): X is I, L or V
  MISC_FEATURE (13)..(13): X is I, L or V
  MISC_FEATURE (14)..(14): X is T or S
  MISC_FEATURE (15)..(15): X is F or P
XXXXXXXXXXXXXXX

SEQ ID NO: 620 - protein, 14 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is N or Q for amidated amino acids
  MISC_FEATURE (4)..(4): X is F or P
  MISC_FEATURE (5)..(5): X is GabaX for X2X3 or X3X2 or X2X3 or X3X2 or X3X3 or X2X2
  MISC_FEATURE (6)..(6): X is K, R or H for basic amino acids
  MISC_FEATURE (7)..(7): X is F or P
  MISC_FEATURE (8)..(8): X is F or P
  MISC_FEATURE (9)..(9): X is K, R or H for basic amino acids
  MISC_FEATURE (10)..(10): X is N or Q for amidated amino acids
  MISC_FEATURE (11)..(11): X is I, L or V
  MISC_FEATURE (12)..(12): X is I, L or V
  MISC_FEATURE (13)..(13): X is T or S
  MISC_FEATURE (14)..(14): X is F or P
XXXXXXXXXXXXXX

SEQ ID NO: 621 - protein, 14 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is N or Q for amidated amino acids
  MISC_FEATURE (4)..(4): X is F or P
  MISC_FEATURE (5)..(5): X is I, L or V
  MISC_FEATURE (6)..(6): X is I, L or V
  MISC_FEATURE (7)..(7): X is K, R or H for basic amino acids
  MISC_FEATURE (8)..(8): X is F or P
  MISC_FEATURE (9)..(9): X is F or P
  MISC_FEATURE (10)..(10): X is K, R or H for basic amino acids
  MISC_FEATURE (11)..(11): X is N or Q for amidated amino acids
  MISC_FEATURE (12)..(12): X is GabaX for X2X3 or X3X2 or X2X3 or X3X2 or X3X3 or X2X2
  MISC_FEATURE (13)..(13): X is T or S
  MISC_FEATURE (14)..(14): X is F or P
XXXXXXXXXXXXXX

SEQ ID NO: 622 - protein, 13 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is N or Q for amidated amino acids
  MISC_FEATURE (4)..(4): X is F or P
  MISC_FEATURE (5)..(5): X is GabaX for X2X3 or X3X2 or X2X3 or X3X2 or X3X3 or X2X2
  MISC_FEATURE (6)..(6): X is K, R or H for basic amino acids
  MISC_FEATURE (7)..(7): X is F or P
  MISC_FEATURE (8)..(8): X is F or P
  MISC_FEATURE (9)..(9): X is K, R or H for basic amino acids
  MISC_FEATURE (10)..(10): X is N or Q for amidated amino acids
  MISC_FEATURE (11)..(11): X is GabaX for X2X3 or X3X2 or X2X3 or X3X2 or X3X3 or X2X2
  MISC_FEATURE (12)..(12): X is T or S
  MISC_FEATURE (13)..(13): X is F or P
XXXXXXXXXXXXX

SEQ ID NO: 623 - protein, 21 aa, Homo sapiens
TGTEKLIETYFSKNYQDYEYL

SEQ ID NO: 624 - protein, 21 aa, Artificial
  Completely synthesized peptide construct
  MISC_FEATURE (1)..(1): X is T or S
  MISC_FEATURE (2)..(2): X is A and G
  MISC_FEATURE (3)..(3): X is T or S
  MISC_FEATURE (4)..(4): X is D and E for acidic amino acids
  MISC_FEATURE (5)..(5): X is K, R or H for basic amino acids
  MISC_FEATURE (6)..(6): X is I, L or V
  MISC_FEATURE (7)..(7): X is I, L or V
  MISC_FEATURE (8)..(8): X is D and E for acidic amino acids
  MISC_FEATURE (9)..(9): X is T or S
  MISC_FEATURE (10)..(10): X is F, W or Y for aromatic amino acids
  MISC_FEATURE (11)..(11): X is F, W or Y for aromatic amino acids
  MISC_FEATURE (12)..(12): X is T or S
  MISC_FEATURE (13)..(13): X is K, R or H for basic amino acids
  MISC_FEATURE (14)..(14): X is N or Q for amidated amino acids
  MISC_FEATURE (15)..(15): X is F, W or Y for aromatic amino acids
  MISC_FEATURE (16)..(16): X is N or Q for amidated amino acids
  MISC_FEATURE (17)..(17): X is D and E for acidic amino acids
  MISC_FEATURE (18)..(18): X is F, W or Y for aromatic amino acids
  MISC_FEATURE (19)..(19): X is D and E for acidic amino acids
  MISC_FEATURE (20)..(20): X is F, W or Y for aromatic amino acids
  MISC_FEATURE (21)..(21): X is I, L or V
XXXXXXXXXXXXXXXXXXXXX

SEQ ID NO: 625 - protein, 21 aa, Artificial
  Completely synthesized peptide construct
  MISC_FEATURE (1)..(1): X is T or S
  MISC_FEATURE (2)..(2): X is A and G
  MISC_FEATURE (3)..(3): X is T or S
  MISC_FEATURE (4)..(4): X is D and E for acidic amino acids
  MISC_FEATURE (5)..(5): X is K, R or H for basic amino acids
  MISC_FEATURE (6)..(6): X is I, L or V
  MISC_FEATURE (7)..(7): X is I, L or V
  MISC_FEATURE (8)..(8): X is D and E for acidic amino acids
  MISC_FEATURE (9)..(9): X is T or S
  MISC_FEATURE (10)..(10): X is F, W or Y for aromatic amino acids
  MISC_FEATURE (11)..(11): X is F, W or Y for aromatic amino acids
  MISC_FEATURE (12)..(12): X is T or S
  MISC_FEATURE (13)..(13): X is K, R or H for basic amino acids
  MISC_FEATURE (14)..(14): X is N or Q for amidated amino acids
  MISC_FEATURE (15)..(15): X is F, W or Y for aromatic amino acids
  MISC_FEATURE (16)..(16): X is N or Q for amidated amino acids
  MISC_FEATURE (17)..(17): X is D and E for acidic amino acids
  MISC_FEATURE (18)..(18): X is F, W or Y for aromatic amino acids
  MISC_FEATURE (19)..(19): X is D and E for acidic amino acids
  MISC_FEATURE (20)..(20): X is F, W or Y for aromatic amino acids
  MISC_FEATURE (21)..(21): X is I, L or V
XXXXXXXXXXXXXXXXXXXXX

SEQ ID NO: 626 - protein, 20 aa, Artificial
  Completely synthesized peptide construct
  MISC_FEATURE (1)..(1): X is T or S
  MISC_FEATURE (2)..(2): X is A and G
  MISC_FEATURE (3)..(3): X is T or S
  MISC_FEATURE (4)..(4): X is D and E for acidic amino acids
  MISC_FEATURE (5)..(5): X is K, R or H for basic amino acids
  MISC_FEATURE (6)..(6): X is GabaX  for X2X3 or X3X2 or X2X3 or X3X2 or X3X3 or X2X2
  MISC_FEATURE (7)..(7): X is D and E for acidic amino acids
  MISC_FEATURE (8)..(8): X is T or S
  MISC_FEATURE (9)..(9): X is F, W or Y for aromatic amino acids
  MISC_FEATURE (10)..(10): X is F, W or Y for aromatic amino acids
  MISC_FEATURE (11)..(11): X is T or S
  MISC_FEATURE (12)..(12): X is K, R or H for basic amino acids
  MISC_FEATURE (13)..(13): X is N or Q for amidated amino acids
  MISC_FEATURE (14)..(14): X is F, W or Y for aromatic amino acids
  misc_feature (15)..(15): Xaa can be any naturally occurring amino acid
  MISC_FEATURE (16)..(16): X is D and E for acidic amino acids
  MISC_FEATURE (17)..(17): X is F, W or Y or aromatic amino acids
  MISC_FEATURE (18)..(18): X is D and E for acidic amino acids
  MISC_FEATURE (19)..(19): X is F, W or Y for aromatic amino acids
  MISC_FEATURE (20)..(20): X is I, L or V
XXXXXXXXXXXXXXXXXXXX

SEQ ID NO: 627 - protein, 20 aa, Artificial
  Completely synthesized peptide construct
  MISC_FEATURE (1)..(1): X is T or S
  MISC_FEATURE (2)..(2): X is A and G
  MISC_FEATURE (3)..(3): X is T or S
  MISC_FEATURE (4)..(4): X is D and E for acidic amino acids
  MISC_FEATURE (5)..(5): X is K, R or H for basic amino acids
  MISC_FEATURE (6)..(6): X is I, L or V
  MISC_FEATURE (7)..(7): X is GabaX for X2X3 or X3X2 or X2X3 or X3X2 or X3X3 or X2X2
  MISC_FEATURE (8)..(8): X is T or S
  MISC_FEATURE (9)..(9): X is F, W or Y for aromatic amino acids
  MISC_FEATURE (10)..(10): X is F, W or Y for aromatic amino acids
  MISC_FEATURE (11)..(11): X is T or S
  MISC_FEATURE (12)..(12): X is K, R or H for basic amino acids
  MISC_FEATURE (13)..(13): X is N or Q for amidated amino acids
  MISC_FEATURE (14)..(14): X is F, W or Y for aromatic amino acids
  MISC_FEATURE (15)..(15): X is T or S
  MISC_FEATURE (16)..(16): X is D and E for acidic amino acids
  MISC_FEATURE (17)..(17): X is F, W or Y for aromatic amino acids
  MISC_FEATURE (18)..(18): X is D and E for acidic amino acids
  MISC_FEATURE (19)..(19): X is F, W or Y for aromatic amino acids
  MISC_FEATURE (20)..(20): X is I, L or V
XXXXXXXXXXXXXXXXXXXX

SEQ ID NO: 628 - protein, 19 aa, Artificial
  Completely synthesized peptide construct
  MISC_FEATURE (1)..(1): X is T or S
  MISC_FEATURE (2)..(2): X is A and G
  MISC_FEATURE (3)..(3): X is T or S
  MISC_FEATURE (4)..(4): X is D and E for acidic amino acids
  MISC_FEATURE (5)..(5): X is K, R or H for basic amino acids
  MISC_FEATURE (6)..(6): X is 5-aminopentanoic acid for replacement of 3 or 4 amino acids of X2 and X3
  MISC_FEATURE (7)..(7): X is T or S
  MISC_FEATURE (8)..(8): X is F, W or Y for aromatic amino acids
  MISC_FEATURE (9)..(9): X is F, W or Y for aromatic amino acids
  MISC_FEATURE (10)..(10): X is T or S
  MISC_FEATURE (11)..(11): X is K, R or H for basic amino acids
  MISC_FEATURE (12)..(12): X is N or Q for amidated amino acids
  MISC_FEATURE (13)..(13): X is F, W or Y for aromatic amino acids
  MISC_FEATURE (14)..(14): X is N or Q for amidated amino acids
  MISC_FEATURE (15)..(15): X is D and E for acidic amino acids
  MISC_FEATURE (16)..(16): X is F, W or Y for aromatic amino acids
  MISC_FEATURE (17)..(17): X is D and E for acidic amino acids
  MISC_FEATURE (18)..(18): X is F, W or Y for aromatic amino acids
  MISC_FEATURE (19)..(19): X is I, L or V
XXXXXXXXXXXXXXXXXXX

SEQ ID NO: 629 - protein, 22 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is A and G
  MISC_FEATURE (4)..(4): X is T or S
  MISC_FEATURE (5)..(5): X is D and E for acidic amino acids
  MISC_FEATURE (6)..(6): X is K, R or H for basic amino acids
  MISC_FEATURE (7)..(7): X is I, L or V
  MISC_FEATURE (8)..(8): X is I, L or V
  MISC_FEATURE (9)..(9): X is D and E for acidic amino acids
  MISC_FEATURE (10)..(10): X is T or S
  MISC_FEATURE (11)..(11): X is F, W or Y for aromatic amino acids
  MISC_FEATURE (12)..(12): X is F, W or Y for aromatic amino acids
  MISC_FEATURE (13)..(13): X is T or S
  MISC_FEATURE (14)..(14): X is K, R or H for basic amino acids
  MISC_FEATURE (15)..(15): X is N or Q for amidated amino acids
  MISC_FEATURE (16)..(16): X is F, W or Y for aromatic amino acids
  MISC_FEATURE (17)..(17): X is N or Q for amidated amino acids
  MISC_FEATURE (18)..(18): X is D and E for acidic amino acids
  MISC_FEATURE (19)..(19): X is F, W or Y for aromatic amino acids
  MISC_FEATURE (20)..(20): X is D and E for acidic amino acids
  MISC_FEATURE (21)..(21): X is F, W or Y for aromatic amino acids
  MISC_FEATURE (22)..(22): X is I, L or V
XXXXXXXXXXXXXXXXXXXXXX

SEQ ID NO: 630 - protein, 22 aa, Artificial
  Completely synthesized peptide construct
  MISC_FEATURE (1)..(1): X is acetly or propionyl group, D glycine or D alanine, cyclohexylalanine at amino terminus
  MISC_FEATURE (2)..(2): X is T or S
  MISC_FEATURE (3)..(3): X is A and G
  MISC_FEATURE (4)..(4): X is T or S
  MISC_FEATURE (5)..(5): X is D and E for acidic amino acids
  MISC_FEATURE (6)..(6): X is K, R or H for basic amino acids
  MISC_FEATURE (7)..(7): X is I, L or V
  MISC_FEATURE (8)..(8): X is I, L or V
  MISC_FEATURE (9)..(9): X is D and E for acidic amino acids
  MISC_FEATURE (10)..(10): X is T or S
  MISC_FEATURE (11)..(11): X is F, W or Y for aromatic amino acids
  MISC_FEATURE (12)..(12): X is F, W or Y for aromatic amino acids
  MISC_FEATURE (13)..(13): X is T or S
  MISC_FEATURE (14)..(14): X is K, R or H for basic amino acids
  MISC_FEATURE (15)..(15): X is N or Q for amidated amino acids
  MISC_FEATURE (16)..(16): X is F, W or Y for aromatic amino acids
  MISC_FEATURE (17)..(17): X is N or Q for amidated amino acids
  MISC_FEATURE (18)..(18): X is D and E for acidic amino acids
  MISC_FEATURE (19)..(19): X is F, W or Y for aromatic amino acids
  MISC_FEATURE (20)..(20): X is D and E for acidic amino acids
  MISC_FEATURE (21)..(21): X is F, W or Y for aromatic amino acids
  MISC_FEATURE (22)..(22): X is I, L or V
XXXXXXXXXXXXXXXXXXXXXX

SEQ ID NO: 631 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is A and G
  MISC_FEATURE (4)..(4): X is T or S
  MISC_FEATURE (5)..(5): X is D and E for acidic amino acids
  MISC_FEATURE (6)..(6): X is K, R or H for basic amino acids
  MISC_FEATURE (7)..(7): X is GabaX2 for X2X3 or X3X2 or X2X3 or X3X2 or X3X3 or X2X2
  MISC_FEATURE (8)..(8): X is D and E for acidic amino acids
  MISC_FEATURE (9)..(9): X is T or S
  MISC_FEATURE (10)..(10): X is F, W or Y for aromatic amino acids
  MISC_FEATURE (11)..(11): X is F, W or Y for aromatic amino acids
  MISC_FEATURE (12)..(12): X is T or S
  MISC_FEATURE (13)..(13): X is K, R or H for basic amino acids
  MISC_FEATURE (14)..(14): X is N or Q for amidated amino acids
  MISC_FEATURE (15)..(15): X is F, W or Y for aromatic amino acids
  MISC_FEATURE (16)..(16): X is N or Q for amidated amino acids
  MISC_FEATURE (17)..(17): X is D and E for acidic amino acids
  MISC_FEATURE (18)..(18): X is F, W or Y for aromatic amino acids
  MISC_FEATURE (19)..(19): X is D and E for aciidic amino acids
  MISC_FEATURE (20)..(20): X is F, W or Y for aromatic amino acids
  MISC_FEATURE (21)..(21): X is I, L or V
XXXXXXXXXXXXXXXXXXXXX

SEQ ID NO: 632 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is A and G
  MISC_FEATURE (4)..(4): X is T or S
  MISC_FEATURE (5)..(5): X is D and E for acidic amino acids
  MISC_FEATURE (6)..(6): X is K, R or H for basic amino acids
  MISC_FEATURE (7)..(7): X is I, L or V
  MISC_FEATURE (8)..(8): X is GabaX for X2X3 or X3X2 or X2X3 or X3X2 or X3X3 or X2X2
  MISC_FEATURE (9)..(9): X is T or S
  MISC_FEATURE (10)..(10): X is F, W or Y for aromatic amino acids
  MISC_FEATURE (11)..(11): X is F, W or Y for aromatic amino acids
  MISC_FEATURE (12)..(12): X is T or S
  MISC_FEATURE (13)..(13): X is K, R or H for basic amino acids
  MISC_FEATURE (14)..(14): X is N or Q for amidated amino acids
  MISC_FEATURE (15)..(15): X is F, W or Y for aromatic amino acids
  MISC_FEATURE (16)..(16): X is N or Q for amidated amino acids
  MISC_FEATURE (17)..(17): X is D and E for acidic amino acids
  MISC_FEATURE (18)..(18): X is F, W or Y for aromatic amino acids
  MISC_FEATURE (19)..(19): X is D and E for acidic amino acids
  MISC_FEATURE (20)..(20): X is F, W or Y for aromatic amino acids
  MISC_FEATURE (21)..(21): X is I, L or V
XXXXXXXXXXXXXXXXXXXXX

SEQ ID NO: 633 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is A and G
  MISC_FEATURE (4)..(4): X is T or S
  MISC_FEATURE (5)..(5): X is D and E for acidic amino acids
  MISC_FEATURE (6)..(6): X is K, R or H for basic amino acids
  MISC_FEATURE (7)..(7): X is 5-aminopentanoic acid for replacement of 3 or 4 amino acids of X2 and X3
  MISC_FEATURE (8)..(8): X is T or S
  MISC_FEATURE (9)..(9): X is F, W or Y for aromatic amino acids
  MISC_FEATURE (10)..(10): X is F, W or Y for aromatic amino acids
  MISC_FEATURE (11)..(11): X is T or S
  MISC_FEATURE (12)..(12): X is K, R or H for basic amino acids
  MISC_FEATURE (13)..(13): X is N or Q for amidated amino acids
  MISC_FEATURE (14)..(14): X is F, W or Y for aromatic amino acids
  MISC_FEATURE (15)..(15): X is N or Q for amidated amino acids
  MISC_FEATURE (16)..(16): X is D and E for acidic amino acids
  MISC_FEATURE (17)..(17): X is F, W or Y for aromatic amino acids
  MISC_FEATURE (18)..(18): X is D and E for basic amino acids
  MISC_FEATURE (19)..(19): X is F, W or Y for aromatic amino acids
  MISC_FEATURE (20)..(20): X is I, L or V
XXXXXXXXXXXXXXXXXXXX

SEQ ID NO: 634 - protein, 13 aa, Artificial
  Completely synthesized peptide construct
  MISC_FEATURE (1)..(1): X is K, R or H for basic amino acids
  MISC_FEATURE (2)..(2): X is T or S
  MISC_FEATURE (3)..(3): X is I, L or V
  MISC_FEATURE (4)..(4): X is A and G
  MISC_FEATURE (5)..(5): X is K, R or H for basic amino acids
  MISC_FEATURE (6)..(6): X is F, W or Y for aromatic amino acids
  MISC_FEATURE (7)..(7): X is I, L or V
  MISC_FEATURE (8)..(8): X is A and G
  MISC_FEATURE (9)..(9): X is K, R or H for basic amino acids
  MISC_FEATURE (10)..(10): X is F or P
  MISC_FEATURE (11)..(11): X is D and E for acidic amino acids
  MISC_FEATURE (12)..(12): X is K, R or H for basic amino acids
  MISC_FEATURE (13)..(13): X is F or P
XXXXXXXXXXXXX

SEQ ID NO: 635 - protein, 14 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is K, R or H for basic amino acids
  MISC_FEATURE (3)..(3): X is T or S
  MISC_FEATURE (4)..(4): X is I, L or V
  MISC_FEATURE (5)..(5): X is A and G
  MISC_FEATURE (6)..(6): X is K, R or H for basic amino acids
  MISC_FEATURE (7)..(7): X is F, W or Y for aromatic amino acids
  MISC_FEATURE (8)..(8): X is I, L or V
  MISC_FEATURE (9)..(9): X is A and G
  MISC_FEATURE (10)..(10): X is K, R or H for basic amino acids
  MISC_FEATURE (11)..(11): X is F or P
  MISC_FEATURE (12)..(12): X is D and E for acidic amino acids
  MISC_FEATURE (13)..(13): X is K, R or H for basic amino acids
  MISC_FEATURE (14)..(14): X is F or P
XXXXXXXXXXXXXX

SEQ ID NO: 636 - protein, 16 aa, Homo sapiens
VGWYRPPFSRVVHLYR

SEQ ID NO: 637 - protein, 16 aa, Artificial
  Completely synthesized peptide construct
  MISC_FEATURE (1)..(1): X is I, L or V
  MISC_FEATURE (2)..(2): X is A and G
  MISC_FEATURE (3)..(3): X is F, W or Y for aromatic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is F or P
  MISC_FEATURE (7)..(7): X is F or P
  MISC_FEATURE (8)..(8): X is F or P
  MISC_FEATURE (9)..(9): X is T or S
  MISC_FEATURE (10)..(10): X is K, R or H for basic amino acids
  MISC_FEATURE (11)..(11): X is I, L or V
  MISC_FEATURE (12)..(12): X is I, L or V
  MISC_FEATURE (13)..(13): X is K, R or H for basic amino acids
  MISC_FEATURE (14)..(14): X is I, L or V
  MISC_FEATURE (15)..(15): X is F, W or Y for aromatic amino acids
  MISC_FEATURE (16)..(16): X is K, R or H for basic amino acids
XXXXXXXXXXXXXXXX

SEQ ID NO: 638 - protein, 15 aa, Artificial
  Completely synthesized peptide construct
  MISC_FEATURE (1)..(1): X is I, L or V
  MISC_FEATURE (2)..(2): X is A and G
  MISC_FEATURE (3)..(3): X is F, W or Y for aromatic amino acids
  MISC_FEATURE (4)..(4): X is F, W or Y for aromatic amino acids
  MISC_FEATURE (5)..(5): X is K, R or H for basic amino acids
  MISC_FEATURE (6)..(6): X is F or P
  MISC_FEATURE (7)..(7): X is F or P
  MISC_FEATURE (8)..(8): X is F or P
  MISC_FEATURE (9)..(9): X is T or S
  MISC_FEATURE (10)..(10): X is K, R or H for basic amino acids
  MISC_FEATURE (11)..(11): X is GabaX for X2X3 or X3X2 or X2X3 or X3X2 or X3X3 or X2X2
  MISC_FEATURE (12)..(12): X is K, R or H for basic amino acids
  MISC_FEATURE (13)..(13): X is I, L or V
  MISC_FEATURE (14)..(14): X is F, W or Y for aromatic amino acids
  MISC_FEATURE (15)..(15): X is K, R or H for basic amino acids
XXXXXXXXXXXXXXX

SEQ ID NO: 639 - protein, 17 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is I, L or V
  MISC_FEATURE (3)..(3): X is A and G
  MISC_FEATURE (4)..(4): X is F, W or Y for aromatic amino acids
  MISC_FEATURE (5)..(5): X is F, W or Y for aromatic amino acids
  MISC_FEATURE (6)..(6): X is F, W or Y for aromatic amino acids
  MISC_FEATURE (7)..(7): X is F or P
  MISC_FEATURE (8)..(8): X is F or P
  MISC_FEATURE (9)..(9): X is F or P
  MISC_FEATURE (10)..(10): X is T or S
  MISC_FEATURE (11)..(11): X is K, R or H for basic amino acids
  MISC_FEATURE (12)..(12): X is I, L or V
  MISC_FEATURE (13)..(13): X is I, L or V
  MISC_FEATURE (14)..(14): X is K, R or H for basic amino acids
  MISC_FEATURE (15)..(15): X is I, L or V
  MISC_FEATURE (16)..(16): X is F, W or Y for aromatic amino acids
  MISC_FEATURE (17)..(17): X is K, R or H for basic amino acids
XXXXXXXXXXXXXXXXX

SEQ ID NO: 640 - protein, 16 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is I, L or V
  MISC_FEATURE (3)..(3): X is A and G
  MISC_FEATURE (4)..(4): X is F, W or Y for aromatic amino acids
  MISC_FEATURE (5)..(5): X is F, W or Y for aromatic amino acids
  MISC_FEATURE (6)..(6): X is K, R or H for basic amino acids
  MISC_FEATURE (7)..(7): X is F or P
  MISC_FEATURE (8)..(8): X is F or P
  MISC_FEATURE (9)..(9): X is F or P
  MISC_FEATURE (10)..(10): X is T or S
  MISC_FEATURE (11)..(11): X is K, R or H for basic amino acids
  MISC_FEATURE (12)..(12): X is GabaX for X2X3 or X3X2 or X2X3 or X3X2 or X3X3 or X2X2
  MISC_FEATURE (13)..(13): X is K, R or H for basic amino acids
  MISC_FEATURE (14)..(14): X is I, L or V
  MISC_FEATURE (15)..(15): X is F, W or Y for aromatic amino acids
  MISC_FEATURE (16)..(16): X is K, R or H for basic amino acids
XXXXXXXXXXXXXXXX

SEQ ID NO: 641 - protein, 16 aa, Homo sapiens
VFLCLQYRLRGKLRAE

SEQ ID NO: 642 - protein, 16 aa, Artificial
  Completely synthesized peptide construct
  MISC_FEATURE (1)..(1): X is I, L or V
  MISC_FEATURE (2)..(2): X is F or P
  MISC_FEATURE (3)..(3): X is I, L or V
  MISC_FEATURE (4)..(4): X is C or S
  MISC_FEATURE (5)..(5): X is I, L or V
  MISC_FEATURE (6)..(6): X is N or Q for amidated amino acids
  MISC_FEATURE (7)..(7): X is F, W or Y for aromatic amino acids
  MISC_FEATURE (8)..(8): X is K, R or H for basic amino acids
  MISC_FEATURE (9)..(9): X is I, L or V
  MISC_FEATURE (10)..(10): X is K, R or H for basic amino acids
  MISC_FEATURE (11)..(11): X is A and G
  MISC_FEATURE (12)..(12): X is K, R or H for basic amino acids
  MISC_FEATURE (13)..(13): X is I, L or V
  MISC_FEATURE (14)..(14): X is K, R or H for basic amino acids
  MISC_FEATURE (15)..(15): X is A and G
  MISC_FEATURE (16)..(16): X is D and E for acidic amino acids
XXXXXXXXXXXXXXXX

SEQ ID NO: 643 - protein, 17 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is I, L or V
  MISC_FEATURE (3)..(3): X is F or P
  MISC_FEATURE (4)..(4): X is I, L or V
  MISC_FEATURE (5)..(5): X is C or S
  MISC_FEATURE (6)..(6): X is I, L or V
  MISC_FEATURE (7)..(7): X is N or Q for amidated amino acids
  MISC_FEATURE (8)..(8): X is F, W or Y for aromatic amino acids
  MISC_FEATURE (9)..(9): X is K, R or H for basic amino acids
  MISC_FEATURE (10)..(10): X is I, L or V
  MISC_FEATURE (11)..(11): X is K, R or H for basic amino acids
  MISC_FEATURE (12)..(12): X is A and G
  MISC_FEATURE (13)..(13): X is K, R or H for basic amino acids
  MISC_FEATURE (14)..(14): X is I, L or V
  MISC_FEATURE (15)..(15): X is K, R or H for basic amino acids
  MISC_FEATURE (16)..(16): X is A and G
  MISC_FEATURE (17)..(17): X is D and E for acidic amino acids
XXXXXXXXXXXXXXXXX

SEQ ID NO: 644 - protein, 21 aa, Artificial
  Completely synthesized peptide construct
MEVGWYRPPFSRVVHLYRNGK

SEQ ID NO: 645 - protein, 21 aa, Artificial
  Completely synthesized peptide construct
  MISC_FEATURE (1)..(1): X is M or Nle (Norleucine)
  MISC_FEATURE (2)..(2): X is D and E for acidic amino acids
  MISC_FEATURE (3)..(3): X is I, L or V
  MISC_FEATURE (4)..(4): X is A and G
  MISC_FEATURE (5)..(5): X is F, W or Y for aromatic amino acids
  MISC_FEATURE (6)..(6): X is F, W or Y for aromatic amino acids
  MISC_FEATURE (7)..(7): X is K, R or H for basic amino acids
  MISC_FEATURE (8)..(8): X is F or P
  MISC_FEATURE (9)..(9): X is F or P
  MISC_FEATURE (10)..(10): X is F or P
  MISC_FEATURE (11)..(11): X is T or S
  MISC_FEATURE (12)..(12): X is K, R or H for basic amino acids
  MISC_FEATURE (13)..(13): X is I, L or V
  MISC_FEATURE (14)..(14): X is I, L or V
  MISC_FEATURE (15)..(15): X is K, R or H for basic amino acids
  MISC_FEATURE (16)..(16): X is I, L or V
  MISC_FEATURE (17)..(17): X is F, W or Y for aromatic amino acids
  MISC_FEATURE (18)..(18): X is K, R or H for basic amino acids
  MISC_FEATURE (19)..(19): X is N or Q for amidated amino acids
  MISC_FEATURE (20)..(20): X is A and G
  MISC_FEATURE (21)..(21): X is K, R or H for basic amino acids
XXXXXXXXXXXXXXXXXXXXX

SEQ ID NO: 646 - protein, 20 aa, Artificial
  Completely synthesized peptide construct
  MISC_FEATURE (1)..(1): X is M or Nle (Norleucine)
  MISC_FEATURE (2)..(2): X is GabaX for X2X3 or X3X2 or X2X3 or X3X2 or X3X3 or X2X2
  MISC_FEATURE (3)..(3): X is A and G
  MISC_FEATURE (4)..(4): X is F, W or Y for aromatic amino acids
  MISC_FEATURE (5)..(5): X is F, W or Y for aromatic amino acids
  MISC_FEATURE (6)..(6): X is K, R or H for basic amino acids
  MISC_FEATURE (7)..(7): X is F or P
  MISC_FEATURE (8)..(8): X is F or P
  MISC_FEATURE (9)..(9): X is F or P
  MISC_FEATURE (10)..(10): X is T or S
  MISC_FEATURE (11)..(11): X is K, R or H for basic amino acids
  MISC_FEATURE (12)..(12): X is I, L or V
  MISC_FEATURE (13)..(13): X is I, L or V
  MISC_FEATURE (14)..(14): X is K, R or H for basic amino acids
  MISC_FEATURE (15)..(15): X is I, L or V
  MISC_FEATURE (16)..(16): X is F, W or Y for aromatic amino acids
  MISC_FEATURE (17)..(17): X is K, R or H for basic amino acids
  MISC_FEATURE (18)..(18): X is N or Q for amidated amino acids
  MISC_FEATURE (19)..(19): X is A and G
  MISC_FEATURE (20)..(20): X is K, R or H for basic amino acids
XXXXXXXXXXXXXXXXXXXX

SEQ ID NO: 647 - protein, 20 aa, Artificial
  Completely synthesized peptide construct
  MISC_FEATURE (1)..(1): X is M or Nle (Norleucine)
  MISC_FEATURE (2)..(2): X is D and E for acidic amino acids
  MISC_FEATURE (3)..(3): X is I, L or V
  MISC_FEATURE (4)..(4): X is A and G
  MISC_FEATURE (5)..(5): X is F, W or Y for aromatic amino acids
  MISC_FEATURE (6)..(6): X is F, W or Y for aromatic amino acids
  MISC_FEATURE (7)..(7): X is K, R or H for basic amino acids
  MISC_FEATURE (8)..(8): X is F or P
  MISC_FEATURE (9)..(9): X is F or P
  MISC_FEATURE (10)..(10): X is F or P
  MISC_FEATURE (11)..(11): X is T or S
  MISC_FEATURE (12)..(12): X is K, R or H for basic amino acids
  MISC_FEATURE (13)..(13): X is Gaba X for X2X3 or X3X2 or X2X3 or X3X2 or X3X3 or X2X2
  misc_feature (14)..(14): Xaa can be any naturally occurring amino acid
  MISC_FEATURE (15)..(15): X is I, L or V
  MISC_FEATURE (16)..(16): X is F, W or Y for aromatic amino acids
  MISC_FEATURE (17)..(17): X is K, R or H for basic amino acids
  MISC_FEATURE (18)..(18): X is N or Q for amidated amino acids
  MISC_FEATURE (19)..(19): X is A and G
  MISC_FEATURE (20)..(20): X is K, R or H for basic amino acids
XXXXXXXXXXXXXXXXXXXX

SEQ ID NO: 648 - protein, 19 aa, Artificial
  Completely synthesized peptide construct
  MISC_FEATURE (1)..(1): X is M or Nle (Norleucine)
  MISC_FEATURE (2)..(2): X is GabaX for X2X3 or X3X2 or X2X3 or X3X2 or X3X3 or X2X2
  MISC_FEATURE (3)..(3): X is A and G
  MISC_FEATURE (4)..(4): X is F, W or Y for aromatic amino acids
  MISC_FEATURE (5)..(5): X is F, W or Y for aromatic amino acids
  MISC_FEATURE (6)..(6): X is K, R or H for basic amino acids
  MISC_FEATURE (7)..(7): X is F or P
  MISC_FEATURE (8)..(8): X is F or P
  MISC_FEATURE (9)..(9): X is F or P
  MISC_FEATURE (10)..(10): X is T or S
  MISC_FEATURE (11)..(11): X is K, R or H for basic amino acids
  MISC_FEATURE (12)..(12): X is GabaX for X2X3 or X3X2 or X2X3 or X3X2 or X3X3 or X2X2
  MISC_FEATURE (13)..(13): X is K, R or H for basic amino acids
  MISC_FEATURE (14)..(14): X is I, L or V
  MISC_FEATURE (15)..(15): X is F, W or Y for aromatic amino acids
  MISC_FEATURE (16)..(16): X is K, R or H for basic amino acids
  MISC_FEATURE (17)..(17): X is N or Q for amidated amino acids
  MISC_FEATURE (18)..(18): X is A and G
  MISC_FEATURE (19)..(19): X is K, R or H for basic amino acids
XXXXXXXXXXXXXXXXXXX

SEQ ID NO: 649 - protein, 22 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is M or Nle (Norleucine)
  MISC_FEATURE (3)..(3): X is D or E for acidic amino acids
  MISC_FEATURE (4)..(4): X is I, L or V
  MISC_FEATURE (5)..(5): X is A and G
  MISC_FEATURE (6)..(6): X is F, W or Y for aromatic amino acids
  MISC_FEATURE (7)..(7): X is F, W or Y for aromatic amino acids
  MISC_FEATURE (8)..(8): X is K, R or H for basic amino acids
  MISC_FEATURE (9)..(9): X is F or P
  MISC_FEATURE (10)..(10): X is F or P
  MISC_FEATURE (11)..(11): X is F or P
  MISC_FEATURE (12)..(12): X is T or S
  MISC_FEATURE (13)..(13): X is K, R or H for basic amino acids
  MISC_FEATURE (14)..(14): X is I, L or V
  MISC_FEATURE (15)..(15): X is I, L or V
  MISC_FEATURE (16)..(16): X is K, R or H for basic amino acids
  MISC_FEATURE (17)..(17): X is I, L or V
  MISC_FEATURE (18)..(18): X is F, W or Y for aromatic amino acids
  MISC_FEATURE (19)..(19): X is K, R or H for basic amino acids
  MISC_FEATURE (20)..(20): X is N or Q for amidated amino acids
  MISC_FEATURE (21)..(21): X is A and G
  MISC_FEATURE (22)..(22): X is K, R or H for basic amino acids
XXXXXXXXXXXXXXXXXXXXXX

SEQ ID NO: 650 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is M or Nle(Norleucine)
  MISC_FEATURE (3)..(3): X is GabaX for X2X3 or X3X2 or X2X3 or X3X2 or X3X3 or X2X2
  MISC_FEATURE (4)..(4): X is A and G
  MISC_FEATURE (5)..(5): X is F, W or Y for aromatic amino acids
  MISC_FEATURE (6)..(6): X is F, W or Y for aromatic amino acids
  MISC_FEATURE (7)..(7): X is K, R or H for basic amino acids
  MISC_FEATURE (8)..(8): X is F or P
  MISC_FEATURE (9)..(9): X is F or P
  MISC_FEATURE (10)..(10): X is F or P
  MISC_FEATURE (11)..(11): X is T or S
  MISC_FEATURE (12)..(12): X is K, R or H for basic amino acids
  MISC_FEATURE (13)..(13): X is I, L or V
  MISC_FEATURE (14)..(14): X is I, L or V
  MISC_FEATURE (15)..(15): X is K, R or H for basic amino acids
  MISC_FEATURE (16)..(16): X is I, L or V
  MISC_FEATURE (17)..(17): X is F, W or Y for aromatic amino acids
  MISC_FEATURE (18)..(18): X is K, R or H for basic amino acids
  MISC_FEATURE (19)..(19): X is N or Q for amidated amino acids
  MISC_FEATURE (20)..(20): X is A and G
  MISC_FEATURE (21)..(21): X is K, R or H for basic amino acids
XXXXXXXXXXXXXXXXXXXXX

SEQ ID NO: 651 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is M or Nle (Norleucine)
  MISC_FEATURE (3)..(3): X is D and E for acidic amino acids
  MISC_FEATURE (4)..(4): X is I, L or V
  MISC_FEATURE (5)..(5): X is A and G
  MISC_FEATURE (6)..(6): X is F, W or Y for aromatic amino acids
  MISC_FEATURE (7)..(7): X is F, W or Y for aromatic amino acids
  MISC_FEATURE (8)..(8): X is K, R or H for basic amino acids
  MISC_FEATURE (9)..(9): X is F or P
  MISC_FEATURE (10)..(10): X is F or P
  MISC_FEATURE (11)..(11): X is F or P
  MISC_FEATURE (12)..(12): X is T or S
  MISC_FEATURE (13)..(13): X is K, R or H for basic amino acids
  MISC_FEATURE (14)..(14): X is GabaX for X2X3 or X3X2 or X2X3 or X3X2 or X3X3 or X2X2
  MISC_FEATURE (15)..(15): X is K, R or H for basic amino acids
  MISC_FEATURE (16)..(16): X is I, L or V
  MISC_FEATURE (17)..(17): X is F, W or Y for aromatic amino acids
  MISC_FEATURE (18)..(18): X is K, R or H for basic amino acids
  MISC_FEATURE (19)..(19): X is N or Q for amidated amino acids
  MISC_FEATURE (20)..(20): X is A and G
  MISC_FEATURE (21)..(21): X is K, R or H for basic amino acids
XXXXXXXXXXXXXXXXXXXXX

SEQ ID NO: 652 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is M or Nle (Norleucine)
  MISC_FEATURE (3)..(3): X is GabaX for X2X3 or X3X2 or X2X3 or X3X2 or X3X3 or X2X2
  MISC_FEATURE (4)..(4): X is A and G
  MISC_FEATURE (5)..(5): X is F, W or Y for aromatic amino acids
  MISC_FEATURE (6)..(6): X is F, W or Y for aromatic amino acids
  MISC_FEATURE (7)..(7): X is K, R or H for basic amino acids
  MISC_FEATURE (8)..(8): X is F or P
  MISC_FEATURE (9)..(9): X is F or P
  MISC_FEATURE (10)..(10): X is F or P
  MISC_FEATURE (11)..(11): X is T or S
  MISC_FEATURE (12)..(12): X is K, R or H for basic amino acids
  MISC_FEATURE (13)..(13): X is GabaX for X2X3 or X3X2 or X2X3 or X3X2 or X3X3 or X2X2
  MISC_FEATURE (14)..(14): X is K, R or H for basic amino acids
  MISC_FEATURE (15)..(15): X is I, L or V
  MISC_FEATURE (16)..(16): X is F, W or Y for aromatic amino acids
  MISC_FEATURE (17)..(17): X is K, R or H for basic amino acids
  MISC_FEATURE (18)..(18): X is N or Q for amidated amino acids
  MISC_FEATURE (19)..(19): X is A and G
  MISC_FEATURE (20)..(20): X is K, R or H for basic amino acids
XXXXXXXXXXXXXXXXXXXX

SEQ ID NO: 653 - protein, 14 aa, Homo sapiens
DGSSWEGVGVVPDV

SEQ ID NO: 654 - protein, 8 aa, Artificial
  Completely synthesized peptide construct
TSSEVATE

SEQ ID NO: 655 - protein, 8 aa, Artificial
  Completely synthesized peptide construct
  MISC_FEATURE (1)..(1): X is T or S
  MISC_FEATURE (2)..(2): X is T or S
  MISC_FEATURE (3)..(3): X is T or S
  MISC_FEATURE (4)..(4): X is D and E for acidic amino acids
  MISC_FEATURE (5)..(5): X is I, L or V
  MISC_FEATURE (6)..(6): X is A and G
  MISC_FEATURE (7)..(7): X is T or S
  MISC_FEATURE (8)..(8): X is D and E for acidic amino acids
XXXXXXXX

SEQ ID NO: 656 - protein, 7 aa, Artificial
  Completely synthesized peptide construct
  MISC_FEATURE (1)..(1): X is T or S
  MISC_FEATURE (2)..(2): X is T or S
  MISC_FEATURE (3)..(3): X is T or S
  MISC_FEATURE (4)..(4): X is GabaX for X2X3 or X3X2 or X2X3 or X3X2 or X3X3 or X2X2
  MISC_FEATURE (5)..(5): X is A and G
  MISC_FEATURE (6)..(6): X is T or S
  MISC_FEATURE (7)..(7): X is D and E for acidic amino acids
XXXXXXX

SEQ ID NO: 657 - protein, 9 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is T or S
  MISC_FEATURE (4)..(4): X is T or S
  MISC_FEATURE (5)..(5): X is D and E for acidic amino acids
  MISC_FEATURE (6)..(6): X is I, L or V
  MISC_FEATURE (7)..(7): X is A and G
  MISC_FEATURE (8)..(8): X is T or S
  MISC_FEATURE (9)..(9): X is D and E for acidic amino acids
XXXXXXXXX

SEQ ID NO: 658 - protein, 8 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is T or S
  MISC_FEATURE (4)..(4): X is T or S
  MISC_FEATURE (5)..(5): X is GabaX for X2X3 or X3X2 or X2X3 or X3X2 or X3X3 or X2X2
  MISC_FEATURE (6)..(6): X is A and G
  MISC_FEATURE (7)..(7): X is T or S
  MISC_FEATURE (8)..(8): X is D and E for acidic amino acids
XXXXXXXX

SEQ ID NO: 659 - protein, 8 aa, Artificial
  Completely synthesized peptide construct
TSSEAATE

SEQ ID NO: 660 - protein, 8 aa, Artificial
  Completely synthesized peptide construct
DTNLASST

SEQ ID NO: 661 - protein, 8 aa, Artificial
  Completely synthesized peptide construct
DTALASST

SEQ ID NO: 662 - protein, 8 aa, Artificial
  Completely synthesized peptide construct
  MISC_FEATURE (1)..(1): X is T or S
  MISC_FEATURE (2)..(2): X is T or S
  MISC_FEATURE (3)..(3): X is T or S
  MISC_FEATURE (4)..(4): X is D and E for acidic amino acids
  MISC_FEATURE (5)..(5): X is A and G
  MISC_FEATURE (6)..(6): X is A and G
  MISC_FEATURE (7)..(7): X is T or S
  MISC_FEATURE (8)..(8): X is D and E for acidic amino acids
XXXXXXXX

SEQ ID NO: 663 - protein, 9 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is T or S
  MISC_FEATURE (4)..(4): X is T or S
  MISC_FEATURE (5)..(5): X is D and E for acidic amino acids
  MISC_FEATURE (6)..(6): X is A and G
  MISC_FEATURE (7)..(7): X is A and G
  MISC_FEATURE (8)..(8): X is T or S
  MISC_FEATURE (9)..(9): X is D and E for acidic amino acids
XXXXXXXXX

SEQ ID NO: 664 - protein, 20 aa, Homo sapiens
GPTHLFQPSLVLDMAKVLLD

SEQ ID NO: 665 - protein, 20 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is I, L or V
  MISC_FEATURE (20)..(20): X is D and E for acidic amino acids
XXXXXXXXXXXXXXXXXXXX

SEQ ID NO: 666 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is GabaX for X2X3 or X3X2 or X2X3 or X3X2 or X3X3 or X2X2
  MISC_FEATURE (11)..(11): X is I, L or V
  MISC_FEATURE (12)..(12): X is D and E for acidic amino acids
  MISC_FEATURE (13)..(13): X is M or Nle (Norleucine)
  MISC_FEATURE (14)..(14): X is A and G
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for acidic amino acids
XXXXXXXXXXXXXXXXXXX

SEQ ID NO: 667 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is GabaX for X2X3 or X3X2 or X2X3 or X3X2 or X3X3 or X2X2
  MISC_FEATURE (12)..(12): X is D and E for acidic amino acids
  MISC_FEATURE (13)..(13): X is M or Nle (Norleucine)
  MISC_FEATURE (14)..(14): X is A and G
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for acidic amino acids
XXXXXXXXXXXXXXXXXXX

SEQ ID NO: 668 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is GabaX for X2X3 or X3X2 or X2X3 or X3X2 or X3X3 or X2X2
  MISC_FEATURE (13)..(13): X is M or Nle (Norleucine)
  MISC_FEATURE (14)..(14): X is A and G
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for basic amino acids
XXXXXXXXXXXXXXXXXXX

SEQ ID NO: 669 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is GabaX for X2X3 or X3X2 or X2X3 or X3X2 or X3X3 or X2X2
  MISC_FEATURE (18)..(18): X is I, L or V
  MISC_FEATURE (19)..(19): X is D and E for acidic amino acids
XXXXXXXXXXXXXXXXXXX

SEQ ID NO: 670 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is GabaX for X2X3 or X3X2 or X2X3 or X3X2 or X3 X3 or X2X2
  MISC_FEATURE (19)..(19): X is D and E for acidic amino acids
XXXXXXXXXXXXXXXXXXX

SEQ ID NO: 671 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is GabaX for X2X3 or X3X2 or X2X3 or X3X2 or X3X3 or X2X2
XXXXXXXXXXXXXXXXXXX

SEQ ID NO: 672 - protein, 18 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is T or S
  MISC_FEATURE (9)..(9): X is I, L or V
  MISC_FEATURE (10)..(10): X is I, L or V
  MISC_FEATURE (11)..(11): X is I, L or V
  MISC_FEATURE (12)..(12): X is D and E for acidic amino acids
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is 5-aminopentanoic acid for replacement of 3 or 4 amino acids of X2 and X3
XXXXXXXXXXXXXXXXXX

SEQ ID NO: 673 - protein, 18 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is 5-aminopentanoic acid for replacement of 3 or 4 amino acids of X2 or X3
  MISC_FEATURE (18)..(18): X is D and E for acidic amino acids
XXXXXXXXXXXXXXXXXX

SEQ ID NO: 674 - protein, 18 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K,  R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is 5-aminopentanoic acid for replacement of 3 or 4 amino acids of X2 and X3
  MISC_FEATURE (11)..(11): X is D and E for acidic amino acids
  MISC_FEATURE (12)..(12): X is M or Nle (Norleucine)
  MISC_FEATURE (13)..(13): X is A and G
  MISC_FEATURE (14)..(14): X is K, R or H for basic amino acids
  MISC_FEATURE (15)..(15): X is I, L or V
  MISC_FEATURE (16)..(16): X is I, L or V
  MISC_FEATURE (17)..(17): X is I, L or V
  MISC_FEATURE (18)..(18): X is D and E for acidic amino acids
XXXXXXXXXXXXXXXXXX

SEQ ID NO: 675 - protein, 17 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is 5-aminopentanoic acid for replacement of 3 or 4 amino acids of X2 and X3
  MISC_FEATURE (11)..(11): X is M or Nle (Norleucine)
  MISC_FEATURE (12)..(12): X is A and G
  MISC_FEATURE (13)..(13): X is K, R or H for basic amino acids
  MISC_FEATURE (14)..(14): X is I, L or V
  MISC_FEATURE (15)..(15): X is I, L or V
  MISC_FEATURE (16)..(16): X is I, L or V
  MISC_FEATURE (17)..(17): X is D and E for acidic amino acids
XXXXXXXXXXXXXXXXX

SEQ ID NO: 676 - protein, 18 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is 5-aminopentanoic acid for replacement of 3 or 4 amino acids of X2 and X3
  MISC_FEATURE (12)..(12): X is M or Nle (Norleucine)
  MISC_FEATURE (13)..(13): X is A and G
  MISC_FEATURE (14)..(14): X is K, R or H for basic amino acids
  MISC_FEATURE (15)..(15): X is I, L or V
  MISC_FEATURE (16)..(16): X is I, L or V
  MISC_FEATURE (17)..(17): X is I, L or V
  MISC_FEATURE (18)..(18): X is D and E for acidic amino acids
XXXXXXXXXXXXXXXXXX

SEQ ID NO: 677 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is GabaX for X2X3 or X3X2 or X2X3 or X3X2 or X3X3 or X2X2
  MISC_FEATURE (11)..(11): X is I, L or V
  MISC_FEATURE (12)..(12): X is D and E for acidic amino acids
  MISC_FEATURE (13)..(13): X is M or Nle (Norleucine)
  MISC_FEATURE (14)..(14): X is A and G
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for acidic amino acids
XXXXXXXXXXXXXXXXXXX

SEQ ID NO: 678 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is GabaX for X2X3 or X3X2 or X2X3 or X3X2 or X3X3 or X2X2
  MISC_FEATURE (12)..(12): X is D and E for acidic amino acids
  MISC_FEATURE (13)..(13): X is M or Nle (Norleucine)
  MISC_FEATURE (14)..(14): X is A and G
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for acidic amino acids
XXXXXXXXXXXXXXXXXXX

SEQ ID NO: 679 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is GabaX for X2X3 or X3X2 or X2X3 or X3X2 or X3X3 or X2X2
  MISC_FEATURE (13)..(13): X is M or Nle (Norleucine)
  MISC_FEATURE (14)..(14): X is A and G
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for acidic amino acids
XXXXXXXXXXXXXXXXXXX

SEQ ID NO: 680 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is GabaX for X2X3 or X3X2 or X2X3 or X3X2 or X3X3 or X2X2
  MISC_FEATURE (18)..(18): X is I, L or V
  MISC_FEATURE (19)..(19): X is D and E for acidic amino acids
XXXXXXXXXXXXXXXXXXX

SEQ ID NO: 681 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is GabaX for X2X3 or X3X2 or X2X3 or X3X2 or X3X3 or X2X2
  MISC_FEATURE (19)..(19): X is D and E for acidic amino acids
XXXXXXXXXXXXXXXXXXX

SEQ ID NO: 682 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is GabaX for X2X3 or X3X2 or X2X3 or X3X2 or X3X3 or X2X2
XXXXXXXXXXXXXXXXXXX

SEQ ID NO: 683 - protein, 20 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is I, L or V
  MISC_FEATURE (20)..(20): X is D and E for acidic amino acids
XXXXXXXXXXXXXXXXXXXX

SEQ ID NO: 684 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is GabaX for X2X3 or X3X2 or X2X3 or X3X2 or X3X3 or X2X2
  MISC_FEATURE (11)..(11): X is I, L or V
  MISC_FEATURE (12)..(12): X is D and E for acidic amino acids
  MISC_FEATURE (13)..(13): X is M or Nle (Norleucine)
  MISC_FEATURE (14)..(14): X is A and G
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for acidic amino acids
XXXXXXXXXXXXXXXXXXX

SEQ ID NO: 685 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is GabaX for X2X3 or X3X2 or X2X3 or X3X2 or X3X3 or X2X2
  MISC_FEATURE (12)..(12): X is D and E for acidic amino acids
  MISC_FEATURE (13)..(13): X is M or Nle (Norleucine)
  MISC_FEATURE (14)..(14): X is A and G
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for acidic amino acids
XXXXXXXXXXXXXXXXXXX

SEQ ID NO: 686 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is GabaX for X2X3 or X3X2 or X2X3 or X3X2 or X3X3 or X2X2
  MISC_FEATURE (13)..(13): X is M or Nle (Norleucine)
  MISC_FEATURE (14)..(14): X is A and G
  MISC_FEATURE (15)..(15): X is A and G
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for acidic amino acids
XXXXXXXXXXXXXXXXXXX

SEQ ID NO: 687 - protein, 19 aa, Artificial
  Completely synthesized peptide construct
  MISC_FEATURE (1)..(1): X is F or P
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is GabaX for X2X3 or X3X2 or X2X3 or X3X2 or X3X3 or X2X2
  MISC_FEATURE (18)..(18): X is I, L or V
  MISC_FEATURE (19)..(19): X is D and E for acidic amino acids
XXXXXXXXXXXXXXXXXXX

SEQ ID NO: 688 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is GabaX for X2X3 or X3X2 or X2X3 or X3X2 or X3X3 or X2X2
  MISC_FEATURE (19)..(19): X is D and E for acidic amino acids
XXXXXXXXXXXXXXXXXXX

SEQ ID NO: 689 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is GabaX for X2X3 or X3X2 or X2X3 or X3X2 or X3X3 or X2X2
XXXXXXXXXXXXXXXXXXX

SEQ ID NO: 690 - protein, 18 aa, Artificial
  Completely synthesized peptide construct
  MISC_FEATURE (1)..(1): X is A and G
  MISC_FEATURE (2)..(2): X is F or P
  MISC_FEATURE (3)..(3): X is K, R or H for basic amino acids
  MISC_FEATURE (4)..(4): X is I, L or V
  MISC_FEATURE (5)..(5): X is F, W or Y for aromatic amino acids
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is 5-aminopentanoic acid for replacement of 3 or 4 amino acids of X2 or X3
XXXXXXXXXXXXXXXXXX

SEQ ID NO: 691 - protein, 18 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is 5-aminopentanoic acid for replacement of 3 or 4 amino acids of X2 or X3
  MISC_FEATURE (18)..(18): X is D and E for acidic amino acids
XXXXXXXXXXXXXXXXXX

SEQ ID NO: 692 - protein, 18 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is 5-aminopentanoic acid for replacement of 3 or 4 amino acids of X2 or X3
  MISC_FEATURE (11)..(11): X is D and E for acidic amino acids
  MISC_FEATURE (12)..(12): X is M or Nle (Norleucine)
  MISC_FEATURE (13)..(13): X is A and G
  MISC_FEATURE (14)..(14): X is K, R or H for basic amino acids
  MISC_FEATURE (15)..(15): X is I, L or V
  MISC_FEATURE (16)..(16): X is I, L or V
  MISC_FEATURE (17)..(17): X is I, L or V
  MISC_FEATURE (18)..(18): X is D and E for acidic amino acids
XXXXXXXXXXXXXXXXXX

SEQ ID NO: 693 - protein, 17 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is 5-aminopentanoic acid for replacement of 3 or 4 amino acids of X2 of X3
  MISC_FEATURE (11)..(11): X is M or Nle (Norleucine)
  MISC_FEATURE (12)..(12): X is A and G
  MISC_FEATURE (13)..(13): X is K, R or H for basic amino acids
  MISC_FEATURE (14)..(14): X is I, L or V
  MISC_FEATURE (15)..(15): X is I, L or V
  MISC_FEATURE (16)..(16): X is I, L or V
  MISC_FEATURE (17)..(17): X is D and E for acidic amino acids
XXXXXXXXXXXXXXXXX

SEQ ID NO: 694 - protein, 18 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is 5-aminopentanoic acid for replacement of 3 or 4 amino acids of X2 or X3
  MISC_FEATURE (11)..(11): X is M or Nle (Norleucine)
  MISC_FEATURE (12)..(12): X is A and G
  MISC_FEATURE (13)..(13): X is K, R or H for basic amino acids
  MISC_FEATURE (14)..(14): X is I, L or V
  MISC_FEATURE (15)..(15): X is I, L or V
  MISC_FEATURE (16)..(16): X is I, L or V
  MISC_FEATURE (17)..(17): X is I, L or V
  MISC_FEATURE (18)..(18): X is D and E for acidic amino acids
XXXXXXXXXXXXXXXXXX

SEQ ID NO: 695 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is GabaX for X2X3 or X3X2 or X2X3 or X3X2 or X3X3 or X2X2
  MISC_FEATURE (11)..(11): X is I, L or V
  MISC_FEATURE (12)..(12): X is D and E for acidic amino acids
  MISC_FEATURE (13)..(13): X is M or Nle (Norleucine)
  MISC_FEATURE (14)..(14): X is A andG
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for acidic amino acids
XXXXXXXXXXXXXXXXXXX

SEQ ID NO: 696 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is GabaX for X2X3 or X3X2 or X2X3 or X3X2 or X3X3 or X2X2
  MISC_FEATURE (12)..(12): X is D and E for acidic amino acids
  MISC_FEATURE (13)..(13): X is M or Nle (Norleucine)
  MISC_FEATURE (14)..(14): X is A and G
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for acidic amino acids
XXXXXXXXXXXXXXXXXXX

SEQ ID NO: 697 - protein, 19 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is I, L or V
  MISC_FEATURE (11)..(11): X is I, L or V
  MISC_FEATURE (12)..(12): X is GabaX for X2X3 or X3X2 or X2X3 or X3X2 or X3X3 or X2X2
  MISC_FEATURE (13)..(13): X is M or Nle (Norleucine)
  MISC_FEATURE (14)..(14): X is A and G
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for acidic amino acids
XXXXXXXXXXXXXXXXXXX

SEQ ID NO: 698 - protein, 17 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is 5-aminopentanoic acid for replacement of 3 or 4 amino acids at X2 or X3
  MISC_FEATURE (11)..(11): X is D and E for acidic amino acids
  MISC_FEATURE (12)..(12): X is M or Nle (Norleucine)
  MISC_FEATURE (13)..(13): X is A and G
  MISC_FEATURE (14)..(14): X is K, R or H for basic amino acids
  MISC_FEATURE (15)..(15): X is GabaX for X2X3 or X3X2 or X2X3 or X3X2 or X3X3 or X2X2
  MISC_FEATURE (16)..(16): X is I, L or V
  MISC_FEATURE (17)..(17): X is D and E for acidic amino acids
XXXXXXXXXXXXXXXXX

SEQ ID NO: 699 - protein, 15 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is 5-aminopentanoic acid for replacement of 3 or 4 amino acids of X2 or X3
  MISC_FEATURE (11)..(11): X is M or Nle (Norleucine)
  MISC_FEATURE (12)..(12): X is A and G
  MISC_FEATURE (13)..(13): X is K, R or H for basic amino acids
  MISC_FEATURE (14)..(14): X is 5-aminopentanoic acid for replacement of 3 or 4 amino acids of X2 or X3
  MISC_FEATURE (15)..(15): X is D and E for acidic amino acids
XXXXXXXXXXXXXXX

SEQ ID NO: 700 - protein, 14 aa, Artificial
  Completely synthesized peptide construct
  MISC_FEATURE (1)..(1): X is A and G
  MISC_FEATURE (2)..(2): X is F or P
  MISC_FEATURE (3)..(3): X is T or S
  MISC_FEATURE (4)..(4): X is K, R or H for basic amino acids
  MISC_FEATURE (5)..(5): X is I, L or V
  MISC_FEATURE (6)..(6): X is F, W or Y for aromatic amino acids
  MISC_FEATURE (7)..(7): X is N or Q for amidated amino acids
  MISC_FEATURE (8)..(8): X is F or P
  MISC_FEATURE (9)..(9): X is T or S
  MISC_FEATURE (10)..(10): X is 5-aminopentanoic acid for replacement of 3 or 4 amino acids of X2 and X3
  MISC_FEATURE (11)..(11): X is M or Nle (Norleucine)
  MISC_FEATURE (12)..(12): X is A and G
  MISC_FEATURE (13)..(13): X is K, R or H for basic amino acids
  MISC_FEATURE (14)..(14): X is 5-aminopentanoic aacid for replacement of 3 or 4 amino acids of X2 and X3
XXXXXXXXXXXXXX

SEQ ID NO: 701 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is I, L or V
  MISC_FEATURE (14)..(14): X is A and G
  MISC_FEATURE (15)..(15): X is M or Nle (Norleucine)
  MISC_FEATURE (16)..(16): X is A and G
  MISC_FEATURE (17)..(17): X is K, R or H for basic amino acids
  MISC_FEATURE (18)..(18): X is I, L or V
  MISC_FEATURE (19)..(19): X is I, L or V
  MISC_FEATURE (20)..(20): X is I, L or V
  MISC_FEATURE (21)..(21): X is D and E for acidic amino acids
XXXXXXXXXXXXXXXXXXXXX

SEQ ID NO: 702 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is GabaX for X2X3 or X3X2 or X2X3 or X3X2 or X3X3 or X2X2
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is I, L or V
  MISC_FEATURE (20)..(20): X is D and E for acidic amino acids
XXXXXXXXXXXXXXXXXXXX

SEQ ID NO: 703 - protein, 20 aa, Artificial
  Completely synthesized peptide construct
  MISC_FEATURE (1)..(1): X is acetyl or propionyl group, D glycine or D alanine, cyclhexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is GabaX for X2X3 or X3X2 or X2X3 or X3X2 or X3X3 or X2X2
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is I, L or V
  MISC_FEATURE (20)..(20): X is D and E for acidic amino acids
XXXXXXXXXXXXXXXXXXXX

SEQ ID NO: 704 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is GabaX for X2X3 or X3X2 or X2X3 or X3X2 or X3X3 or X2X2
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is I, L or V
  MISC_FEATURE (20)..(20): X is D and E for acidic amino acids
XXXXXXXXXXXXXXXXXXXX

SEQ ID NO: 705 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is K, R or H for basic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is I, L or V
  MISC_FEATURE (14)..(14): X is D and E for acidic amino acids
  MISC_FEATURE (15)..(15): X is M or Nle (Norleucine)
  MISC_FEATURE (16)..(16): X is A and G
  MISC_FEATURE (17)..(17): X is K, R or H for basic amino acids
  MISC_FEATURE (18)..(18): X is I, L or V
  MISC_FEATURE (18)..(18): X is GabaX for X2X3 or X3X2 or X2X3 or X3X2 or X3X3 or X2X2
  MISC_FEATURE (19)..(19): X is I, L or V
  MISC_FEATURE (20)..(20): X is D and E for acidic amino acids
XXXXXXXXXXXXXXXXXXXX

SEQ ID NO: 706 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is I, L or V
  MISC_FEATURE (14)..(14): X is D and E for acidic amino acids
  MISC_FEATURE (15)..(15): X is M or Nle (Norleucine)
  MISC_FEATURE (16)..(16): X is A and G
  MISC_FEATURE (17)..(17): X is K, R or H for basic amino acids
  MISC_FEATURE (18)..(18): X is I, L or V
  MISC_FEATURE (19)..(19): X is GabaX for X2X3 or X3X2 or X2X3 or X3X2 or X3X3 or X2X2
  MISC_FEATURE (20)..(20): X is D and E for acidic amino acids
XXXXXXXXXXXXXXXXXXXX

SEQ ID NO: 707 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is I, L or V
  MISC_FEATURE (14)..(14): X is D and E for acidic amino acids
  MISC_FEATURE (15)..(15): X is M or Nle (Norleucine)
  MISC_FEATURE (16)..(16): X is A and G
  MISC_FEATURE (17)..(17): X is K, R or H for basic amino acids
  MISC_FEATURE (18)..(18): X is I, L or V
  MISC_FEATURE (19)..(19): X is I, L or V
  MISC_FEATURE (20)..(20): X is GabaX for X2X3 or X3X2 or X2X3 or X3X2 or X3X3 or X2X2
XXXXXXXXXXXXXXXXXXXX

SEQ ID NO: 708 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is I, L or V
  MISC_FEATURE (14)..(14): X is D and E for acidic amino acids
  MISC_FEATURE (15)..(15): X is M or Nle (Norleucine)
  MISC_FEATURE (16)..(16): X is A and G
  MISC_FEATURE (17)..(17): X is K, R or H for basic amino acids
  MISC_FEATURE (18)..(18): X is I, L or V
  MISC_FEATURE (19)..(19): X is 5-aminopentanoic acid for replacement of 3 or 4 amino acids of X2 and X3
XXXXXXXXXXXXXXXXXXX

SEQ ID NO: 709 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is I, L or V
  MISC_FEATURE (14)..(14): X is D and E for acidic amino acids
  MISC_FEATURE (15)..(15): X is M or Nle (Norleucine)
  MISC_FEATURE (16)..(16): X is A and G
  MISC_FEATURE (17)..(17): X is K, R or H for basic amino acids
  MISC_FEATURE (18)..(18): X is 5-aminopentanoic acid for replacement of 3 or 4 amino acids of X2 and X3
  MISC_FEATURE (19)..(19): X is D and E for acidic amino acids
XXXXXXXXXXXXXXXXXXX

SEQ ID NO: 710 - protein, 19 aa, Artificial
  Completely synthesized peptide construct
  MISC_FEATURE (1)..(1): X is acetyl or propionyl group, D glycine and D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is 5-aminopentanoic acid for replacement of 3 or 4 amino acids of X2 and X3
  MISC_FEATURE (12)..(12): X is D and E for acidic amino acids
  MISC_FEATURE (13)..(13): X is M or Nle (Norleucine)
  MISC_FEATURE (14)..(14): X is A and G
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for acidic amino acids
XXXXXXXXXXXXXXXXXXX

SEQ ID NO: 711 - protein, 18 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is 5-aminopentanoic acid for replacement of 3 or 4 amino acids of X2 and X3
  MISC_FEATURE (12)..(12): X is M or Nle (Norleucine)
  MISC_FEATURE (13)..(13): X is A and G
  MISC_FEATURE (14)..(14): X is K, R or H for basic amino acids
  MISC_FEATURE (15)..(15): X is I, L or V
  MISC_FEATURE (16)..(16): X is I, L or V
  MISC_FEATURE (17)..(17): X is I, L or V
  MISC_FEATURE (18)..(18): X is D and E for acidic amino acids
XXXXXXXXXXXXXXXXXX

SEQ ID NO: 712 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is 5-aminopentanoic acid for replacement of 3 or 4 amino acids of X2 and X3
  MISC_FEATURE (13)..(13): X is M or Nle (Norleucine)
  MISC_FEATURE (14)..(14): X is A and G
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for acidic amino acids
XXXXXXXXXXXXXXXXXXX

SEQ ID NO: 713 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is GabaX for X2X3 or X3X2 or X2X3 or X3X2 or X3X3 or X2X2
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is I, L or V
  MISC_FEATURE (20)..(20): X is D and E for acidic amino acids
XXXXXXXXXXXXXXXXXXXX

SEQ ID NO: 714 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is GabaX for X2X3 or X3X2 or X2X3 or X3X2 or X3X3 or X2X2
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is I, L or V
  MISC_FEATURE (20)..(20): X is D and E for acidic amino acids
XXXXXXXXXXXXXXXXXXXX

SEQ ID NO: 715 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is GabaX for X2X3 or X3X2 or X2X3 or X3X2 or X3X3 or X2X2
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is I, L or V
  MISC_FEATURE (20)..(20): X is D and E for acidic amino acids
XXXXXXXXXXXXXXXXXXXX

SEQ ID NO: 716 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is I, L or V
  MISC_FEATURE (14)..(14): X is D and E for acidic amino acids
  MISC_FEATURE (15)..(15): X is M or Nle (Norleucine)
  MISC_FEATURE (16)..(16): X is A and G
  MISC_FEATURE (17)..(17): X is K, R or H for basic amino acids
  MISC_FEATURE (18)..(18): X is GabaX for X2X3 or X3X2 or X2X3 or X3X2 or X3X3 or X2X2
  MISC_FEATURE (19)..(19): X is I, L or V
  MISC_FEATURE (20)..(20): X is D and E for acidic amino acids
XXXXXXXXXXXXXXXXXXXX

SEQ ID NO: 717 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is I, L or V
  MISC_FEATURE (14)..(14): X is D and E for acidic amino acids
  MISC_FEATURE (15)..(15): X is M or Nle (Norleucine)
  MISC_FEATURE (16)..(16): X is A and G
  MISC_FEATURE (17)..(17): X is K, R or H for basic amino acids
  MISC_FEATURE (18)..(18): X is I, L or V
  MISC_FEATURE (19)..(19): X is GabaX for X2X3 or X3X2 or X2X3 or X3X2 or X3X3 or X2X2
  MISC_FEATURE (20)..(20): X is D and E for acidic amino acids
XXXXXXXXXXXXXXXXXXXX

SEQ ID NO: 718 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is I, L or V
  MISC_FEATURE (14)..(14): X is D and E for acidic amino acids
  MISC_FEATURE (15)..(15): X is M or Nle (Norleucine)
  MISC_FEATURE (16)..(16): X is A and G
  MISC_FEATURE (17)..(17): X is K, R or H for basic amino acids
  MISC_FEATURE (18)..(18): X is I, L or V
  MISC_FEATURE (19)..(19): X is I, L or V
  MISC_FEATURE (20)..(20): X is GabaX for X2X3 or X3X2 or X2X3 or X3X2 or X3X3 or X2X2
XXXXXXXXXXXXXXXXXXXX

SEQ ID NO: 719 - protein, 21 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is I, L or V
  MISC_FEATURE (14)..(14): X is D and E for acidic amino acids
  MISC_FEATURE (15)..(15): X is M or Nle (Norleucine)
  MISC_FEATURE (16)..(16): X is A and G
  MISC_FEATURE (17)..(17): X is K, R or H for basic amino acids
  MISC_FEATURE (18)..(18): X is I, L or V
  MISC_FEATURE (19)..(19): X is I, L or V
  MISC_FEATURE (20)..(20): X is I, L or V
  MISC_FEATURE (21)..(21): X is D and E for acidic amino acids
XXXXXXXXXXXXXXXXXXXXX

SEQ ID NO: 720 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is GabaX for X2X3 or X3X2 or X2X3 or X3X2 or X3X3 or X2X2
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is I, L or V
  MISC_FEATURE (20)..(20): X is D and E for acidic amino acids
XXXXXXXXXXXXXXXXXXXX

SEQ ID NO: 721 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is GabaX for X2X3 or X3X2 or X2X3 or X3X2 or X3X3 or X2X2
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is A and G
  MISC_FEATURE (17)..(17): X is I, L or V
  MISC_FEATURE (18)..(18): X is I, L or V
  MISC_FEATURE (19)..(19): X is I, L or V
  MISC_FEATURE (20)..(20): X is D and E for acidic amino acids
XXXXXXXXXXXXXXXXXXXX

SEQ ID NO: 722 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is GabaX for X2X3 or X3X2 or X2X3 or X3X2 or X3X3 or X2X2
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is I, L or V
  MISC_FEATURE (20)..(20): X is D and E for acidic amino acids
XXXXXXXXXXXXXXXXXXXX

SEQ ID NO: 723 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is I, L or V
  MISC_FEATURE (14)..(14): X is D and E for acidic amino acids
  MISC_FEATURE (15)..(15): X is M or Nle (Norleucine)
  MISC_FEATURE (16)..(16): X is A and G
  MISC_FEATURE (17)..(17): X is K, R or H for basic amino acids
  MISC_FEATURE (18)..(18): X is GabaX for X2X3 or X3X2 or X2X3 or X3X2 or X3X3 or X2X2
  MISC_FEATURE (19)..(19): X is I, L or V
  MISC_FEATURE (20)..(20): X is D and E for acidic amino acids
XXXXXXXXXXXXXXXXXXXX

SEQ ID NO: 724 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is I, L or V
  MISC_FEATURE (14)..(14): X is D and E for acidic amino acids
  MISC_FEATURE (15)..(15): X is M or Nle (Norleucine)
  MISC_FEATURE (16)..(16): X is A and G
  MISC_FEATURE (17)..(17): X is K, R or H for basic amino acids
  MISC_FEATURE (18)..(18): X is I, L or V
  MISC_FEATURE (19)..(19): X is GabaX for X2X3 or X3X2 or X2X3 or X3X2 or X3X3 or X2X2
  MISC_FEATURE (20)..(20): X is D and E for acidic amino acids
XXXXXXXXXXXXXXXXXXXX

SEQ ID NO: 725 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is I, L or V
  MISC_FEATURE (14)..(14): X is D and E for acidic amino acids
  MISC_FEATURE (15)..(15): X is M or Nle (Norleucine)
  MISC_FEATURE (16)..(16): X is A and G
  MISC_FEATURE (17)..(17): X is K, R or H for basic amino acids
  MISC_FEATURE (18)..(18): X is I, L or V
  MISC_FEATURE (19)..(19): X is I, L or V
  MISC_FEATURE (20)..(20): X is GabaX for X2X3 or X3X2 or X2X3 or X3X2 or X3X3 or X2X2
XXXXXXXXXXXXXXXXXXXX

SEQ ID NO: 726 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is I, L or V
  MISC_FEATURE (14)..(14): X is D and E for acidic amino acids
  MISC_FEATURE (15)..(15): X is M or Nle (Norleucine)
  MISC_FEATURE (16)..(16): X is A and G
  MISC_FEATURE (17)..(17): X is K, R or H for basic amino acids
  MISC_FEATURE (18)..(18): X is I, L or V
  MISC_FEATURE (19)..(19): X is 5-aminopentanoic acid for replacement of 3 or 4 amino acids of X2 and X3
XXXXXXXXXXXXXXXXXXX

SEQ ID NO: 727 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is I, L or V
  MISC_FEATURE (14)..(14): X is D and E for acidic amino acids
  MISC_FEATURE (15)..(15): X is M or Nle (Norleucine)
  MISC_FEATURE (16)..(16): X is A and G
  MISC_FEATURE (17)..(17): X is K, R or H for basic amino acids
  MISC_FEATURE (18)..(18): X is 5-aminopentanoic acid for replacement of 3 or 4 amino acids of X2 and X3
  MISC_FEATURE (19)..(19): X is D and E for acidic amino acids
XXXXXXXXXXXXXXXXXXX

SEQ ID NO: 728 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is 5-aminopentanoic acid for replacement of 3 or 4 amino acids of X2 and X3
  MISC_FEATURE (12)..(12): X is D and E for acidic amino acids
  MISC_FEATURE (13)..(13): X is M or Nle (Norleucine)
  MISC_FEATURE (14)..(14): X is A and G
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for acidic amino acids
XXXXXXXXXXXXXXXXXXX

SEQ ID NO: 729 - protein, 18 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is 5-aminopentanoic acid for replacement of 3 or 4 amino acids of X2 and X3
  MISC_FEATURE (12)..(12): X is M or Nle (Norleucine)
  MISC_FEATURE (13)..(13): X is A and G
  MISC_FEATURE (14)..(14): X is K, R or H for basic amino acids
  MISC_FEATURE (15)..(15): X is I, L or V
  MISC_FEATURE (16)..(16): X is I, L or V
  MISC_FEATURE (17)..(17): X is I, L or V
  MISC_FEATURE (18)..(18): X is D and E for acidic amino acids
XXXXXXXXXXXXXXXXXX

SEQ ID NO: 730 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is 5-aminopentanoic acid for replacement of 3 or 4 amino acids of X2 and X3
  MISC_FEATURE (13)..(13): X is M or Nle (Norleucine)
  MISC_FEATURE (14)..(14): X is A and G
  MISC_FEATURE (15)..(15): X is K, R or H for basic amino acids
  MISC_FEATURE (16)..(16): X is I, L or V
  MISC_FEATURE (17)..(17): X is I, L or V
  MISC_FEATURE (18)..(18): X is I, L or V
  MISC_FEATURE (19)..(19): X is D and E for acidic amino acids
XXXXXXXXXXXXXXXXXXX

SEQ ID NO: 731 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is GabaX for X2X3 or X3X2 or X2X3 or X3X2 or X3X3 or X2X2
  MISC_FEATURE (12)..(12): X is I, L or V
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is I, L or V
  MISC_FEATURE (20)..(20): X is D and E for acidic amino acids
XXXXXXXXXXXXXXXXXXXX

SEQ ID NO: 732 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is GabaX for X2X3 or X3X2 or X2X3 or X3X2 or X3X3 or X2X2
  MISC_FEATURE (13)..(13): X is D and E for acidic amino acids
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is I, L or V
  MISC_FEATURE (20)..(20): X is D and E for acidic amino acids
XXXXXXXXXXXXXXXXXXXX

SEQ ID NO: 733 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is I, L or V
  MISC_FEATURE (12)..(12): X is I, L or V
  MISC_FEATURE (13)..(13): X is GabaX for X2X3 or X3X2 or X2X3 or X3X2 or X3X3 or X2X2
  MISC_FEATURE (14)..(14): X is M or Nle (Norleucine)
  MISC_FEATURE (15)..(15): X is A and G
  MISC_FEATURE (16)..(16): X is K, R or H for basic amino acids
  MISC_FEATURE (17)..(17): X is I, L or V
  MISC_FEATURE (18)..(18): X is I, L or V
  MISC_FEATURE (19)..(19): X is I, L or V
  MISC_FEATURE (20)..(20): X is D and E for acidic amino acids
XXXXXXXXXXXXXXXXXXXX

SEQ ID NO: 734 - protein, 18 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is 5-aminopentanoic acid for replacement of 3 or 4 amino acids of X2 and X3
  MISC_FEATURE (12)..(12): X is D and E for acidic amino acids
  MISC_FEATURE (13)..(13): X is M or Nle (Norleucine)
  MISC_FEATURE (14)..(14): X is A and G
  MISC_FEATURE (15)..(15): X is K, R or H for basic amino acids
  MISC_FEATURE (16)..(16): X is GabaX for X2X3 or X3X2 or X2X3 or X3X2 or X3X3 or X2X2
  MISC_FEATURE (17)..(17): X is I, L or V
  MISC_FEATURE (18)..(18): X is D and E for acidic amino acids
XXXXXXXXXXXXXXXXXX

SEQ ID NO: 735 - protein, 16 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is 5-aminopentanoic acid for replacement of 3 or 4 amino acids of X2 and X3
  MISC_FEATURE (12)..(12): X is M or Nle (Norleucine)
  MISC_FEATURE (13)..(13): X is A and G
  MISC_FEATURE (14)..(14): X is K, R or H for basic amino acids
  MISC_FEATURE (15)..(15): X is 5-aminopentanoic acid for replacement of 3 or 4 amino acids of X2 and X3
  MISC_FEATURE (16)..(16): X is D and E for acidic amino acids
XXXXXXXXXXXXXXXX

SEQ ID NO: 736 - protein, 15 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F or P
  MISC_FEATURE (4)..(4): X is T or S
  MISC_FEATURE (5)..(5): X is K, R or H for basic amino acids
  MISC_FEATURE (6)..(6): X is I, L or V
  MISC_FEATURE (7)..(7): X is F, W or Y for aromatic amino acids
  MISC_FEATURE (8)..(8): X is N or Q for amidated amino acids
  MISC_FEATURE (9)..(9): X is F or P
  MISC_FEATURE (10)..(10): X is T or S
  MISC_FEATURE (11)..(11): X is 5-aminopentanoic acid for replacement of 3 or 4 amino acids of X2 and X3
  MISC_FEATURE (12)..(12): X is M or Nle (Norleucine)
  MISC_FEATURE (13)..(13): X is A and G
  MISC_FEATURE (14)..(14): X is K, R or H for basic amino acids
  MISC_FEATURE (15)..(15): X is 5-aminopentanoic acid for replacement of 3 or 4 amino acids of X2 and X3
XXXXXXXXXXXXXXX

SEQ ID NO: 737 - protein, 13 aa, Homo sapiens
VIVELIPSTSSAV

SEQ ID NO: 738 - protein, 18 aa, Homo sapiens
DTPYLDITYHFVMQRLPL

SEQ ID NO: 739 - protein, 18 aa, Artificial
  Completely synthesized peptide construct
  MISC_FEATURE (1)..(1): X is D and E for acidic amino acids
  MISC_FEATURE (2)..(2): X is T or S
  MISC_FEATURE (3)..(3): X is F or P
  MISC_FEATURE (4)..(4): X is F, W or Y for aromatic amino acids
  MISC_FEATURE (5)..(5): X is I, L or V
  MISC_FEATURE (6)..(6): X is D and E for acidic amino acids
  MISC_FEATURE (7)..(7): X is I, L or V
  MISC_FEATURE (8)..(8): X is T or S
  MISC_FEATURE (9)..(9): X is F, W or Y for aromatic amino acids
  MISC_FEATURE (10)..(10): X is K, R or H for basic amino acids
  MISC_FEATURE (11)..(11): X is F or P
  MISC_FEATURE (12)..(12): X is I, L or V
  MISC_FEATURE (13)..(13): X is M or Nle (Norleucine)
  MISC_FEATURE (14)..(14): X is N or Q for amidated amino acids
  MISC_FEATURE (15)..(15): X is K, R or H for basic amino acids
  MISC_FEATURE (16)..(16): X is I, L or V
  MISC_FEATURE (17)..(17): X is F or P
  MISC_FEATURE (18)..(18): X is I, L or V
XXXXXXXXXXXXXXXXXX

SEQ ID NO: 740 - protein, 17 aa, Artificial
  Completely synthesized peptide construct
  MISC_FEATURE (1)..(1): X is D and E for acidic amino acids
  MISC_FEATURE (2)..(2): X is T or S
  MISC_FEATURE (3)..(3): X is F or P
  MISC_FEATURE (4)..(4): X is F, W or Y for aromatic amino acids
  MISC_FEATURE (5)..(5): X is GabaX for X2X3 or X3X2 or X2X3 or X3X2 or X3X3 or X2X2
  MISC_FEATURE (6)..(6): X is I, L or V
  MISC_FEATURE (7)..(7): X is T or S
  MISC_FEATURE (8)..(8): X is F, W or Y for aromatic amino acids
  MISC_FEATURE (9)..(9): X is K, R or H for basic amino acids
  MISC_FEATURE (10)..(10): X is F or P
  MISC_FEATURE (11)..(11): X is I, L or V
  MISC_FEATURE (12)..(12): X is M or Nle (Norleucine)
  MISC_FEATURE (13)..(13): X is N or Q for amidated amino acids
  MISC_FEATURE (14)..(14): X is K, R or H for basic amino acids
  MISC_FEATURE (15)..(15): X is I, L or V
  MISC_FEATURE (16)..(16): X is F or P
  MISC_FEATURE (17)..(17): X is I, L or V
XXXXXXXXXXXXXXXXX

SEQ ID NO: 741 - protein, 17 aa, Artificial
  Completely synthesized peptide construct
  MISC_FEATURE (1)..(1): X is D and E for acidic amino acids
  MISC_FEATURE (2)..(2): X is T or S
  MISC_FEATURE (3)..(3): X is F or P
  MISC_FEATURE (4)..(4): X is F, W or Y for aromatic amino acids
  MISC_FEATURE (5)..(5): X is I, L or V
  MISC_FEATURE (6)..(6): X is GabaX for X2X3 or X3X2 or X2X3 or X3X2 or X3X3 or X2X2
  MISC_FEATURE (7)..(7): X is T or S
  MISC_FEATURE (8)..(8): X is F, W or Y for aromatic amino acids
  MISC_FEATURE (9)..(9): X is K, R or H for basic amino acids
  MISC_FEATURE (10)..(10): X is F or P
  MISC_FEATURE (11)..(11): X is I, L or V
  MISC_FEATURE (12)..(12): X is M or Nle (Norleucine)
  MISC_FEATURE (13)..(13): X is N or Q for amidated amino acids
  MISC_FEATURE (14)..(14): X is K, R or H for basic amino acids
  MISC_FEATURE (15)..(15): X is I, L or V
  MISC_FEATURE (16)..(16): X is F or P
  MISC_FEATURE (17)..(17): X is I, L or V
XXXXXXXXXXXXXXXXX

SEQ ID NO: 742 - protein, 16 aa, Artificial
  Completely synthesized peptide construct
  MISC_FEATURE (1)..(1): X is D and E for acidic amino acids
  MISC_FEATURE (2)..(2): X is T or S
  MISC_FEATURE (3)..(3): X is F or P
  MISC_FEATURE (4)..(4): X is F, W or Y for aromatic amino acids
  MISC_FEATURE (5)..(5): X is 5-aminopentanoic acid for replacement of 3 or 4 amino acids of X2 and X3
  MISC_FEATURE (6)..(6): X is T or S
  MISC_FEATURE (7)..(7): X is F, W or Y for aromatic amino acids
  MISC_FEATURE (8)..(8): X is K, R or H for basic amino acids
  MISC_FEATURE (9)..(9): X is F or P
  MISC_FEATURE (10)..(10): X is I, L or V
  MISC_FEATURE (11)..(11): X is M or Nle (Norleucine)
  MISC_FEATURE (12)..(12): X is N or Q for amidated amino acids
  MISC_FEATURE (13)..(13): X is K, R or H for basic amino acids
  MISC_FEATURE (14)..(14): X is I, L or V
  MISC_FEATURE (15)..(15): X is F or P
  MISC_FEATURE (16)..(16): X is I, L or V
XXXXXXXXXXXXXXXX

SEQ ID NO: 743 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is T or S
  MISC_FEATURE (4)..(4): X is F or P
  MISC_FEATURE (5)..(5): X is F, W or Y for aromatic amino acids
  MISC_FEATURE (6)..(6): X is I, L or V
  MISC_FEATURE (7)..(7): X is D and E for acidic amino acids
  MISC_FEATURE (8)..(8): X is I, L or V
  MISC_FEATURE (9)..(9): X is T or S
  MISC_FEATURE (10)..(10): X is F, W or Y for aromatic amino acids
  MISC_FEATURE (11)..(11): X is K, R or H for basic amino acids
  MISC_FEATURE (12)..(12): X is F or P
  MISC_FEATURE (13)..(13): X is I, L or V
  MISC_FEATURE (14)..(14): X is M or Nle (Norleucine)
  MISC_FEATURE (15)..(15): X is N or Q for amidated amino acids
  MISC_FEATURE (16)..(16): X is K, R or H for basic amino acids
  MISC_FEATURE (17)..(17): X is I, L or V
  MISC_FEATURE (18)..(18): X is F or P
  MISC_FEATURE (19)..(19): X is I, L or V
XXXXXXXXXXXXXXXXXXX

SEQ ID NO: 744 - protein, 18 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is T or S
  MISC_FEATURE (4)..(4): X is F or P
  MISC_FEATURE (5)..(5): X is F, W or Y for aromatic amino acids
  MISC_FEATURE (6)..(6): X is GabaX for X2X3 or X3X2 or X2X3 or X3X2 or X3X3 or X2X2
  MISC_FEATURE (7)..(7): X is I, L or V
  MISC_FEATURE (8)..(8): X is T or S
  MISC_FEATURE (9)..(9): X is F, W or Y for aromatic amino acids
  MISC_FEATURE (10)..(10): X is K, R or H for basic amino acids
  MISC_FEATURE (11)..(11): X is F or P
  MISC_FEATURE (12)..(12): X is I, L or V
  MISC_FEATURE (13)..(13): X is M or Nle (Norleucine)
  MISC_FEATURE (14)..(14): X is N or Q for amidated amino acids
  MISC_FEATURE (15)..(15): X is K, R or H for basic amino acids
  MISC_FEATURE (16)..(16): X is I, L or V
  MISC_FEATURE (17)..(17): X is F or P
  MISC_FEATURE (18)..(18): X is I, L or V
XXXXXXXXXXXXXXXXXX

SEQ ID NO: 745 - protein, 18 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is T or S
  MISC_FEATURE (4)..(4): X is F or P
  MISC_FEATURE (5)..(5): X is F, W or Y for aromatic amino acids
  MISC_FEATURE (6)..(6): X is I, L or V
  MISC_FEATURE (7)..(7): X is GabaX for X2X3 or X3X2 or X2X3 or X3X2 or X3X3 or X2X2
  MISC_FEATURE (8)..(8): X is T or S
  MISC_FEATURE (9)..(9): X is F, W or Y for aromatic amino acids
  MISC_FEATURE (10)..(10): X is K, R or H for basic amino acids
  MISC_FEATURE (11)..(11): X is F or P
  MISC_FEATURE (12)..(12): X is I, L or V
  MISC_FEATURE (13)..(13): X is M or Nle (Norleucine)
  MISC_FEATURE (14)..(14): X is N or Q for amidated amino acids
  MISC_FEATURE (15)..(15): X is K, R or H for basic amino acids
  MISC_FEATURE (16)..(16): X is I, L or V
  MISC_FEATURE (17)..(17): X is F or P
  MISC_FEATURE (18)..(18): X is I, L or V
XXXXXXXXXXXXXXXXXX

SEQ ID NO: 746 - protein, 17 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is T or S
  MISC_FEATURE (4)..(4): X is F or P
  MISC_FEATURE (5)..(5): X is F, W or Y for aromatic amino acids
  MISC_FEATURE (6)..(6): X is 5-aminopentanoic acid for replacement of 3 or 4 amino acids of X2 and X3
  MISC_FEATURE (7)..(7): X is T or S
  MISC_FEATURE (8)..(8): X is F, W or Y for aromatic amino acids
  MISC_FEATURE (9)..(9): X is K, R or H for basic amino acids
  MISC_FEATURE (10)..(10): X is F or P
  MISC_FEATURE (11)..(11): X is I, L or V
  MISC_FEATURE (12)..(12): X is M or Nle (Norleucine)
  MISC_FEATURE (13)..(13): X is N or Q for amidated amino acids
  MISC_FEATURE (14)..(14): X is K, R or H for basic amino acids
  MISC_FEATURE (15)..(15): X is I, L or V
  MISC_FEATURE (16)..(16): X is F or P
  MISC_FEATURE (17)..(17): X is I, L or V
XXXXXXXXXXXXXXXXX

SEQ ID NO: 747 - protein, 9 aa, Artificial
  Completely synthesized peptide construct
  MISC_FEATURE (1)..(1): X is A and G
  MISC_FEATURE (2)..(2): X is F, W or Y for aromatic amino acids
  MISC_FEATURE (3)..(3): X is M or Nle (Norleucine)
  MISC_FEATURE (4)..(4): X is T or S
  MISC_FEATURE (5)..(5): X is M or Nle (Norleucine)
  MISC_FEATURE (6)..(6): X is K, R or H for basic amino acids
  MISC_FEATURE (7)..(7): X is I, L or V
  MISC_FEATURE (8)..(8): X is K, R or H for basic amino acids
  MISC_FEATURE (9)..(9): X is N or Q for amidated amino acids
XXXXXXXXX

SEQ ID NO: 748 - protein, 10 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is A and G
  MISC_FEATURE (3)..(3): X is F, W or Y for aromatic amino acids
  MISC_FEATURE (4)..(4): X is M or Nle (Norleucine)
  MISC_FEATURE (5)..(5): X is T or S
  MISC_FEATURE (6)..(6): X is M or Nle (Norleucine)
  MISC_FEATURE (7)..(7): X is K, R or H for basic amino acids
  MISC_FEATURE (8)..(8): X is I, L or V
  MISC_FEATURE (9)..(9): X is K, R or H for basic amino acids
  MISC_FEATURE (10)..(10): X is N or Q for amidated amino acids
XXXXXXXXXX

SEQ ID NO: 749 - protein, 25 aa, Homo sapiens
KRKLEGDLKLTQESIMDLENDKQQL

SEQ ID NO: 750 - protein, 25 aa, Artificial
  Completely synthesized peptide construct
  MISC_FEATURE (1)..(1): X is K, R or H for basic amino acids
  MISC_FEATURE (2)..(2): X is K, R or H for basic amino acids
  MISC_FEATURE (3)..(3): X is K, R or H for basic amino acids
  MISC_FEATURE (4)..(4): X is I, L or V
  MISC_FEATURE (5)..(5): X is D and E for acidic amino acids
  MISC_FEATURE (6)..(6): X is A and G
  MISC_FEATURE (7)..(7): X is D and E for acidic amino acids
  MISC_FEATURE (8)..(8): X is I, L or V
  MISC_FEATURE (9)..(9): X is K, R or H for basic amino acids
  MISC_FEATURE (10)..(10): X is I, L or V
  MISC_FEATURE (11)..(11): X is T or S
  MISC_FEATURE (12)..(12): X is N or Q for amidated amino acids
  MISC_FEATURE (13)..(13): X is I, L or V
  MISC_FEATURE (14)..(14): X is T or S
  MISC_FEATURE (15)..(15): X is I, L or V
  MISC_FEATURE (16)..(16): X is M or Nle (Norleucine)
  MISC_FEATURE (17)..(17): X is D and E for acidic amino acids
  MISC_FEATURE (18)..(18): X is I, L or V
  MISC_FEATURE (19)..(19): X is D and E for acidic amino acids
  MISC_FEATURE (20)..(20): X is N or Q for amidated amino acids
  MISC_FEATURE (21)..(21): X is D and E for acidic amino acids
  MISC_FEATURE (22)..(22): X is K, R or H for basic amino acids
  MISC_FEATURE (23)..(23): X is N or Q for amidated amino acids
  MISC_FEATURE (24)..(24): X is N or Q for amidated amino acids
  MISC_FEATURE (25)..(25): X is I, L or V
XXXXXXXXXXXXXXXXXXXXXXXXX

SEQ ID NO: 751 - protein, 19 aa, Homo sapiens
  MISC_FEATURE (1)..(1): X is acetyl or propionyl group, D glycine or D alanine, cyclohexylalanine at amino terminus
  MISC_FEATURE (2)..(2): X is K, R or H for basic amino acids
  MISC_FEATURE (3)..(3): X is K, R or H for basic amino acids
  MISC_FEATURE (4)..(4): X is K, R or H for basic amino acids
  MISC_FEATURE (5)..(5): X is I, L or V
  MISC_FEATURE (6)..(6): X is D and E for acidic amino acids
  MISC_FEATURE (7)..(7): X is A and G
  MISC_FEATURE (8)..(8): X is D and E for acidic amino acids
  MISC_FEATURE (9)..(9): X is I, L or V
  MISC_FEATURE (10)..(10): X is K, R or H for basic amino acids
  MISC_FEATURE (11)..(11): X is I, L or V
  MISC_FEATURE (12)..(12): X is T or S
  MISC_FEATURE (13)..(13): X is N or Q for amidated amino acids
  MISC_FEATURE (14)..(14): X is I, L or V
  MISC_FEATURE (15)..(15): X is T or S
  MISC_FEATURE (16)..(16): X is I, L or V
  MISC_FEATURE (17)..(17): X is M or Nle (Norleucine)
  MISC_FEATURE (18)..(18): X is D and E for acidic amino groups
  MISC_FEATURE (19)..(19): X is I, L or V
  MISC_FEATURE (20)..(20): X is D and E for acidic amino acids
  MISC_FEATURE (21)..(21): X is N or Q for amidated amino acids
  MISC_FEATURE (22)..(22): X is D and E for acidic amino acids
  MISC_FEATURE (23)..(23): X is K, R or H for basic amino acids
  MISC_FEATURE (24)..(24): X is N or Q for amidated amino acids
  MISC_FEATURE (25)..(25): X is N or Q for amidated amino acids
  MISC_FEATURE (26)..(26): X is I, L or V
VRRLAMENNIKLSEVVGSG

SEQ ID NO: 752 - protein, 22 aa, Artificial
  Completely synthesized peptide construct
  MISC_FEATURE (1)..(1): X is K, R or H for basic amino acids
  MISC_FEATURE (2)..(2): X is K, R or H for basic amino acids
  MISC_FEATURE (3)..(3): X is K, R or H for basic amino acids
  MISC_FEATURE (4)..(4): X is GabaX for X2X3 or X3X2 or X2X3 or X3X2 or X3X3 or X2X2
  MISC_FEATURE (5)..(5): X is A and G
  MISC_FEATURE (6)..(6): X is GabaX for X2X3 or X3X2 or X2X3 or X3X2 or X3X3 or X2X2
  MISC_FEATURE (7)..(7): X is K, R or H for basic amino acids
  MISC_FEATURE (8)..(8): X is I, L or V
  MISC_FEATURE (9)..(9): X is T or S
  MISC_FEATURE (10)..(10): X is N or Q for amidated amino acids
  MISC_FEATURE (11)..(11): X is I, L or V
  MISC_FEATURE (12)..(12): X is T or S
  MISC_FEATURE (13)..(13): X is I, L or V
  MISC_FEATURE (14)..(14): X is M or Nle (Norleucine)
  MISC_FEATURE (15)..(15): X is GabaX for X2X3 or X3X2 or X2X3 or X3X2 or X3X3 or X2X2
  MISC_FEATURE (16)..(16): X is D and E for acidic amino acids
  MISC_FEATURE (17)..(17): X is N or Q for amidated amino acids
  MISC_FEATURE (18)..(18): X is D and E for acidic amino acids
  MISC_FEATURE (19)..(19): X is K, R or H for basic amino acids
  MISC_FEATURE (20)..(20): X is N or Q for amidated amino acids
  MISC_FEATURE (21)..(21): X is N or Q for amidated amino acids
  MISC_FEATURE (22)..(22): X is I, L or V
XXXXXXXXXXXXXXXXXXXXXX

SEQ ID NO: 753 - protein, 18 aa, Homo sapiens
  MISC_FEATURE (1)..(1): X is acetyl or propionyl group, D glycine or D alanine, cyclohexylalanine at amino terminus
  MISC_FEATURE (2)..(2): X is K, R or H for basic amino acids
  MISC_FEATURE (3)..(3): X is K, R or H for basic amino acids
  MISC_FEATURE (4)..(4): X is K, R or H for basic amino acids
  MISC_FEATURE (5)..(5): X is GabaX for X2X3 or X3X2 or X2X3 or X3X2 or X3X3 or X2X2
  MISC_FEATURE (6)..(6): X is A and G
  MISC_FEATURE (7)..(7): X is GabaX for X2X3 or X3X2 or X2X3 or X3X2 or X3X3 or X2X2
  MISC_FEATURE (8)..(8): X is K, R or H for basic amino acids
  MISC_FEATURE (9)..(9): X is I, L or V
  MISC_FEATURE (10)..(10): X is T or S
  MISC_FEATURE (11)..(11): X is N or Q for amidated amino acids
  MISC_FEATURE (12)..(12): X is I, L or V
  MISC_FEATURE (13)..(13): X is T or S
  MISC_FEATURE (14)..(14): X is I, L or V
  MISC_FEATURE (15)..(15): X is M or Nle (Norleucine)
  MISC_FEATURE (16)..(16): X is GabaX for X2X3 or X3X2 or X2X3 or X3X2 or X3X3 or X2X2
  MISC_FEATURE (17)..(17): X is D and E for acidic amino acids
  MISC_FEATURE (18)..(18): X is N or Q for amidated amino acids
  MISC_FEATURE (19)..(19): X is D and E for acidic amino acids
  MISC_FEATURE (20)..(20): X is K, R or H for basic amino acids
  MISC_FEATURE (21)..(21): X is N or Q for amidated amino acids
  MISC_FEATURE (22)..(22): X is N or Q for amidated amino acids
  MISC_FEATURE (23)..(23): X is I, L or V
KEALISSLTRGKLTYTQQ

SEQ ID NO: 754 - protein, 23 aa, Artificial
  Completely synthesized peptide construct
  MISC_FEATURE (1)..(1): X is K, R or H for basic amino acids
  MISC_FEATURE (2)..(2): X is K, R or H for basic amino acids
  MISC_FEATURE (3)..(3): X is K, R or H for basic amino acids
  MISC_FEATURE (4)..(4): X is I, L or V
  MISC_FEATURE (5)..(5): X is D and E for acidic amino acids
  MISC_FEATURE (6)..(6): X is A and G
  MISC_FEATURE (7)..(7): X is D and E for acidic amino acids
  MISC_FEATURE (8)..(8): X is I, L or V
  MISC_FEATURE (9)..(9): X is K, R or H for basic amino acids
  MISC_FEATURE (10)..(10): X is I, L or V
  MISC_FEATURE (11)..(11): X is T or S
  MISC_FEATURE (12)..(12): X is N or Q for amidated amino acids
  MISC_FEATURE (13)..(13): X is I, L or V
  MISC_FEATURE (14)..(14): X is T or S
  MISC_FEATURE (15)..(15): X is I, L or V
  MISC_FEATURE (16)..(16): X is M or Nle (Norleucine)
  MISC_FEATURE (17)..(17): X is 5-aminopentanoic acid for replacement of 3 or 4 amino acids of X2 and X3
  MISC_FEATURE (18)..(18): X is N or Q for amidated amino acids
  MISC_FEATURE (19)..(19): X is D and E for acidic amino acids
  MISC_FEATURE (20)..(20): X is K, R or H for basic amino acids
  MISC_FEATURE (21)..(21): X is N or Q for amidated amino acids
  MISC_FEATURE (22)..(22): X is N or Q for amidated amino acids
  MISC_FEATURE (23)..(23): X is I, L or V
XXXXXXXXXXXXXXXXXXXXXXX

SEQ ID NO: 755 - protein, 18 aa, Homo sapiens
  MISC_FEATURE (1)..(1): X is acetyl or propionyl group, D glycine or D alanine, cyclohexylalanine at amino terminus
  MISC_FEATURE (2)..(2): X is K, R or H for basic amino acids
  MISC_FEATURE (3)..(3): X is K, R or H for basic amino acids
  MISC_FEATURE (4)..(4): X is K, R or H for basic amino acids
  MISC_FEATURE (5)..(5): X is I, L or V
  MISC_FEATURE (6)..(6): X is D and E for acidic amino acids
  MISC_FEATURE (7)..(7): X is A and G
  MISC_FEATURE (8)..(8): X is D and E for acidic amino acids
  MISC_FEATURE (9)..(9): X is I, L or V
  MISC_FEATURE (10)..(10): X is K, R or H for basic amino acids
  MISC_FEATURE (11)..(11): X is I, L or V
  MISC_FEATURE (12)..(12): X is T or S
  MISC_FEATURE (13)..(13): X is N or Q for amidated amino acids
  MISC_FEATURE (14)..(14): X is I, L or V
  MISC_FEATURE (15)..(15): X is T or S
  MISC_FEATURE (16)..(16): X is I, L or V
  MISC_FEATURE (17)..(17): X is M or Nle (Norleucine)
  MISC_FEATURE (18)..(18): X is 5-aminopentanoic acid for replacement of 3 or 4 amino acids of X2 and X3
  MISC_FEATURE (19)..(19): X is N or Q for amidated amino acids
  MISC_FEATURE (20)..(20): X is D and E for acidic amino acids
  MISC_FEATURE (21)..(21): X is K, R or H for basic amino acids
  MISC_FEATURE (22)..(22): X is N or Q for amidated amino acids
  MISC_FEATURE (23)..(23): X is N or Q for amidated amino acids
  MISC_FEATURE (24)..(24): X is I, L or V
SERVQLLHSQNTSLINQK

SEQ ID NO: 756 - protein, 19 aa, Artificial
  Completely synthesized peptide construct
  MISC_FEATURE (1)..(1): X is I, L or V
  MISC_FEATURE (2)..(2): X is K, R or H for basic amino acids
  MISC_FEATURE (3)..(3): X is K, R or H for basic amino acids
  MISC_FEATURE (4)..(4): X is I, L or V
  MISC_FEATURE (5)..(5): X is A and G
  MISC_FEATURE (6)..(6): X is M or Nle (Norleucine)
  MISC_FEATURE (7)..(7): X is D and E for acidic amino acids
  MISC_FEATURE (8)..(8): X is N or Q for amidated amino acids
  MISC_FEATURE (9)..(9): X is N or Q for amidated amino acids
  MISC_FEATURE (10)..(10): X is I, L or V
  MISC_FEATURE (11)..(11): X is K, R or H for basic amino acids
  MISC_FEATURE (12)..(12): X is I, L or V
  MISC_FEATURE (13)..(13): X is T or S
  MISC_FEATURE (14)..(14): X is D and E for acidic amino acids
  MISC_FEATURE (15)..(15): X is I, L or V
  MISC_FEATURE (16)..(16): X is I, L or V
  MISC_FEATURE (17)..(17): X is A and G
  MISC_FEATURE (18)..(18): X is T or S
  MISC_FEATURE (19)..(19): X is A and G
XXXXXXXXXXXXXXXXXXX

SEQ ID NO: 757 - protein, 20 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is I, L or V
  MISC_FEATURE (3)..(3): X is K, R or H for basic amino acids
  MISC_FEATURE (4)..(4): X is K, R or H for basic amino acids
  MISC_FEATURE (5)..(5): X is I, L or V
  MISC_FEATURE (6)..(6): X is A and G
  MISC_FEATURE (7)..(7): X is M or Nle (Norleucine)
  MISC_FEATURE (8)..(8): X is D and E for acidic amino acids
  MISC_FEATURE (9)..(9): X is N or Q for amidated amino acids
  MISC_FEATURE (10)..(10): X is N or Q for amidated amino acids
  MISC_FEATURE (11)..(11): X is I, L or V
  MISC_FEATURE (12)..(12): X is K, R or H for basic amino acids
  MISC_FEATURE (13)..(13): X is I, L or V
  MISC_FEATURE (14)..(14): X is T or S
  MISC_FEATURE (15)..(15): X is D and E for acidic amino acids
  MISC_FEATURE (16)..(16): X is I, L or V
  MISC_FEATURE (17)..(17): X is I, L or V
  MISC_FEATURE (18)..(18): X is A and G
  MISC_FEATURE (19)..(19): X is T or S
  MISC_FEATURE (20)..(20): X is A and G
XXXXXXXXXXXXXXXXXXXX

SEQ ID NO: 758 - protein, 18 aa, Artificial
  Completely synthesized peptide construct
  MISC_FEATURE (1)..(1): X is I, L or V
  MISC_FEATURE (2)..(2): X is K, R or H for basic amino acids
  MISC_FEATURE (3)..(3): X is K, R or H for basic amino acids
  MISC_FEATURE (4)..(4): X is I, L or V
  MISC_FEATURE (5)..(5): X is A and G
  MISC_FEATURE (6)..(6): X is M or Nle (Norleucine)
  MISC_FEATURE (7)..(7): X is D and E for acidic amino acids
  MISC_FEATURE (8)..(8): X is N or Q for amidated amino acids
  MISC_FEATURE (9)..(9): X is N or Q for amidated amino acids
  MISC_FEATURE (10)..(10): X is I, L or V
  MISC_FEATURE (11)..(11): X is K, R or H for basic amino acids
  MISC_FEATURE (12)..(12): X is I, L or V
  MISC_FEATURE (13)..(13): X is T or S
  MISC_FEATURE (14)..(14): X is GabaX for X2X3 or X3X2 or X2X3 or X3X2 or X3X3 or X2X2
  MISC_FEATURE (15)..(15): X is I, L or V
  MISC_FEATURE (16)..(16): X is A and G
  MISC_FEATURE (17)..(17): X is T or S
  MISC_FEATURE (18)..(18): X is A and G
XXXXXXXXXXXXXXXXXX

SEQ ID NO: 759 - protein, 17 aa, Artificial
  Completely synthesized peptide construct
  MISC_FEATURE (1)..(1): X is I, L or V
  MISC_FEATURE (2)..(2): X is K, R or H for basic amino acids
  MISC_FEATURE (3)..(3): X is K, R or H for basic amino acids
  MISC_FEATURE (4)..(4): X is I, L or V
  MISC_FEATURE (5)..(5): X is A and G
  MISC_FEATURE (6)..(6): X is M or Nle (Norleucine)
  MISC_FEATURE (7)..(7): X is D and E for acidic amino acids
  MISC_FEATURE (8)..(8): X is N or Q for amidated amino acids
  MISC_FEATURE (9)..(9): X is N or Q for amidated amino acids
  MISC_FEATURE (10)..(10): X is I, L or V
  MISC_FEATURE (11)..(11): X is K, R or H for basic amino acids
  MISC_FEATURE (12)..(12): X is I, L or V
  MISC_FEATURE (13)..(13): X is T or S
  MISC_FEATURE (14)..(14): X is 5-aminopentanoic acid for replacement of 3 or 4 amino acids of X2 and X3
  MISC_FEATURE (15)..(15): X is A and G
  MISC_FEATURE (16)..(16): X is T or S
  MISC_FEATURE (17)..(17): X is A and G
XXXXXXXXXXXXXXXXX

SEQ ID NO: 760 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is I, L or V
  MISC_FEATURE (3)..(3): X is K, R or H for basic amino acids
  MISC_FEATURE (4)..(4): X is K, R or H for basic amino acids
  MISC_FEATURE (5)..(5): X is I, L or V
  MISC_FEATURE (6)..(6): X is A and G
  MISC_FEATURE (7)..(7): X is M or Nle (Norleucine)
  MISC_FEATURE (8)..(8): X is D and E for acidic amino acids
  MISC_FEATURE (9)..(9): X is N or Q for amidated amino acids
  MISC_FEATURE (10)..(10): X is N or Q for amidated amino acids
  MISC_FEATURE (11)..(11): X is I, L or V
  MISC_FEATURE (12)..(12): X is K, R or H for basic amino acids
  MISC_FEATURE (13)..(13): X is I, L or V
  MISC_FEATURE (14)..(14): X is T or S
  MISC_FEATURE (15)..(15): X is GabaX for X2X3 or X3X2 or X2X3 or X3X2 or X3X3 or X2X2
  MISC_FEATURE (16)..(16): X is I, L or V
  MISC_FEATURE (17)..(17): X is A and G
  MISC_FEATURE (18)..(18): X is T or S
  MISC_FEATURE (19)..(19): X is A and G
XXXXXXXXXXXXXXXXXXX

SEQ ID NO: 761 - protein, 18 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is I, L or V
  MISC_FEATURE (3)..(3): X is K, R or H for basic amino acids
  MISC_FEATURE (4)..(4): X is K, R or H for basic amino acids
  MISC_FEATURE (5)..(5): X is I, L or V
  MISC_FEATURE (6)..(6): X is A and G
  MISC_FEATURE (7)..(7): X is M or Nle (Norleucine)
  MISC_FEATURE (8)..(8): X is D and E for acidic amino acids
  MISC_FEATURE (9)..(9): X is N or Q for amidated amino acids
  MISC_FEATURE (10)..(10): X is N or Q for amidated amino acids
  MISC_FEATURE (11)..(11): X is I, L or V
  MISC_FEATURE (12)..(12): X is K, R or H for basic amino acids
  MISC_FEATURE (13)..(13): X is I, L or V
  MISC_FEATURE (14)..(14): X is T or S
  MISC_FEATURE (15)..(15): X is 5-aminopentanoic acid for replacement of 3 or 4 amino acids of X2 and X3
  MISC_FEATURE (16)..(16): X is A and G
  MISC_FEATURE (17)..(17): X is T or S
  MISC_FEATURE (18)..(18): X is A and G
XXXXXXXXXXXXXXXXXX

SEQ ID NO: 762 - protein, 18 aa, Artificial
  Completely synthesized peptide construct
  MISC_FEATURE (1)..(1): X is K, R or H for basic amino acids
  MISC_FEATURE (2)..(2): X is D and E for acidic amino acids
  MISC_FEATURE (3)..(3): X is A and G
  MISC_FEATURE (4)..(4): X is I, L or V
  MISC_FEATURE (5)..(5): X is I, L or V
  MISC_FEATURE (6)..(6): X is T or S
  MISC_FEATURE (7)..(7): X is T or S
  MISC_FEATURE (8)..(8): X is I, L or V
  MISC_FEATURE (9)..(9): X is T or S
  MISC_FEATURE (10)..(10): X is K, R or H for basic amino acids
  MISC_FEATURE (11)..(11): X is A and G
  MISC_FEATURE (12)..(12): X is K, R or H for basic amino acids
  MISC_FEATURE (13)..(13): X is I, L or V
  MISC_FEATURE (14)..(14): X is T or S
  MISC_FEATURE (15)..(15): X is F, W or Y for aromatic amino acids
  MISC_FEATURE (16)..(16): X is T or S
  MISC_FEATURE (17)..(17): X is N or Q for amidated amino acids
  MISC_FEATURE (18)..(18): X is N or Q for amidated amino acids
XXXXXXXXXXXXXXXXXX

SEQ ID NO: 763 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is K, R or H for basic amino acids
  MISC_FEATURE (3)..(3): X is D and E for acidic amino acids
  MISC_FEATURE (4)..(4): X is A and G
  MISC_FEATURE (5)..(5): X is I, L or V
  MISC_FEATURE (6)..(6): X is I, L or V
  MISC_FEATURE (7)..(7): X is T or S
  MISC_FEATURE (8)..(8): X is T or S
  MISC_FEATURE (9)..(9): X is I, L or V
  MISC_FEATURE (10)..(10): X is T or S
  MISC_FEATURE (11)..(11): X is K, R or H for basic amino acids
  MISC_FEATURE (12)..(12): X is A and G
  MISC_FEATURE (13)..(13): X is K, R or H for basic amino acids
  MISC_FEATURE (14)..(14): X is I, L or V
  MISC_FEATURE (15)..(15): X is T or S
  MISC_FEATURE (16)..(16): X is F, W or Y for aromatic amino acids
  MISC_FEATURE (17)..(17): X is T or S
  MISC_FEATURE (18)..(18): X is N or Q for amidated amino acids
  MISC_FEATURE (19)..(19): X is N or Q for amidated amino acids
XXXXXXXXXXXXXXXXXXX

SEQ ID NO: 764 - protein, 17 aa, Artificial
  Completely synthesized peptide construct
  MISC_FEATURE (1)..(1): X is K, R or H for basic amino acids
  MISC_FEATURE (2)..(2): X is D and E for acidic amino acids
  MISC_FEATURE (3)..(3): X is A and G
  MISC_FEATURE (4)..(4): X is GabaX for X2X3 or X3X2 or X2X3 or X3X2 or X3X3 or X2X2
  MISC_FEATURE (5)..(5): X is T or S
  MISC_FEATURE (6)..(6): X is T or S
  MISC_FEATURE (7)..(7): X is I, L or V
  MISC_FEATURE (8)..(8): X is T or S
  MISC_FEATURE (9)..(9): X is K, R or H for basic amino acids
  MISC_FEATURE (10)..(10): X is A and G
  MISC_FEATURE (11)..(11): X is K, R or H for basic amino acids
  MISC_FEATURE (12)..(12): X is I, L or V
  MISC_FEATURE (13)..(13): X is T or S
  MISC_FEATURE (14)..(14): X is F, W or Y for aromatic amino acids
  MISC_FEATURE (15)..(15): X is T or S
  MISC_FEATURE (16)..(16): X is N or Q for amidated amino acids
  MISC_FEATURE (17)..(17): X is N or Q for amidated amino acids
XXXXXXXXXXXXXXXXX

SEQ ID NO: 765 - protein, 18 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is K, R or H for basic amino acids
  MISC_FEATURE (3)..(3): X is D and E for acidic amino acids
  MISC_FEATURE (4)..(4): X is A and G
  MISC_FEATURE (5)..(5): X is GabaX for X2X3 or X3X2 or X2X3 or X3X2 or X3X3 or X2X2
  MISC_FEATURE (6)..(6): X is T or S
  MISC_FEATURE (7)..(7): X is T or S
  MISC_FEATURE (8)..(8): X is I, L or V
  MISC_FEATURE (9)..(9): X is T or S
  MISC_FEATURE (10)..(10): X is K, R or H for basic amino acids
  MISC_FEATURE (11)..(11): X is A and G
  MISC_FEATURE (12)..(12): X is K, R or H for basic amino acids
  MISC_FEATURE (13)..(13): X is I, L or V
  MISC_FEATURE (14)..(14): X is T or S
  MISC_FEATURE (15)..(15): X is F, W or Y for aromatic amino acids
  MISC_FEATURE (16)..(16): X is T or S
  MISC_FEATURE (17)..(17): X is N or Q for amidated amino acids
  MISC_FEATURE (18)..(18): X is N or Q for amidated amino acids
XXXXXXXXXXXXXXXXXX

SEQ ID NO: 766 - protein, 18 aa, Artificial
  Completely synthesized peptide construct
  MISC_FEATURE (1)..(1): X is T or S
  MISC_FEATURE (2)..(2): X is D and E for acidic amino acids
  MISC_FEATURE (3)..(3): X is K, R or H for basic amino acids
  MISC_FEATURE (4)..(4): X is I, L or V
  MISC_FEATURE (5)..(5): X is N or Q for amidated amino acids
  MISC_FEATURE (6)..(6): X is I, L or V
  MISC_FEATURE (7)..(7): X is I, L or V
  MISC_FEATURE (8)..(8): X is K, R or H for basic amino acids
  MISC_FEATURE (9)..(9): X is T or S
  MISC_FEATURE (10)..(10): X is N or Q for amidated amino acids
  MISC_FEATURE (11)..(11): X is N or Q for amidated amino acids
  MISC_FEATURE (12)..(12): X is T or S
  MISC_FEATURE (13)..(13): X is T or S
  MISC_FEATURE (14)..(14): X is I, L or V
  MISC_FEATURE (15)..(15): X is I, L or V
  MISC_FEATURE (16)..(16): X is T or S
  MISC_FEATURE (17)..(17): X is T or S
  MISC_FEATURE (18)..(18): X is K, R or H for basic amino acids
XXXXXXXXXXXXXXXXXX

SEQ ID NO: 767 - protein, 18 aa, Artificial
  Completely synthesized peptide construct
  MISC_FEATURE (1)..(1): X is T or S
  MISC_FEATURE (2)..(2): X is D and E for acidic amino acids
  MISC_FEATURE (3)..(3): X is K, R or H for basic amino acids
  MISC_FEATURE (4)..(4): X is I, L or V
  MISC_FEATURE (5)..(5): X is N or Q for amidated amino acids
  MISC_FEATURE (6)..(6): X is I, L or V
  MISC_FEATURE (7)..(7): X is I, L or V
  MISC_FEATURE (8)..(8): X is K, R or H for basic amino acids
  MISC_FEATURE (9)..(9): X is T or S
  MISC_FEATURE (10)..(10): X is N or Q for amidated amino acids
  MISC_FEATURE (11)..(11): X is N or Q for amidated amino acids
  MISC_FEATURE (12)..(12): X is T or S
  MISC_FEATURE (13)..(13): X is T or S
  MISC_FEATURE (14)..(14): X is I, L or V
  MISC_FEATURE (15)..(15): X is I, L or V
  MISC_FEATURE (16)..(16): X is T or S
  MISC_FEATURE (17)..(17): X is T or S
  MISC_FEATURE (18)..(18): X is K, R or H for basic amino acids
XXXXXXXXXXXXXXXXXX

SEQ ID NO: 768 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is D and E for acidic amino acids
  MISC_FEATURE (4)..(4): X is K, R or H for basic amino acids
  MISC_FEATURE (5)..(5): X is I, L or V
  MISC_FEATURE (6)..(6): X is N or Q for amidated amino acids
  MISC_FEATURE (7)..(7): X is I, L or V
  MISC_FEATURE (8)..(8): X is I, L or V
  MISC_FEATURE (9)..(9): X is K, R or H for basic amino acids
  MISC_FEATURE (10)..(10): X is T or S
  MISC_FEATURE (11)..(11): X is N or Q for amidated amino acids
  MISC_FEATURE (12)..(12): X is N or Q for amidated amino acids
  MISC_FEATURE (13)..(13): X is T or S
  MISC_FEATURE (14)..(14): X is T or S
  MISC_FEATURE (15)..(15): X is I, L or V
  MISC_FEATURE (16)..(16): X is I, L or V
  MISC_FEATURE (17)..(17): X is T or S
  MISC_FEATURE (18)..(18): X is T or S
  MISC_FEATURE (19)..(19): X is K, R or H for basic amino acids
XXXXXXXXXXXXXXXXXXX

SEQ ID NO: 769 - protein, 17 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is T or S
  MISC_FEATURE (3)..(3): X is D and E for acidic amino acids
  MISC_FEATURE (4)..(4): X is K, R or H for basic amino acids
  MISC_FEATURE (5)..(5): X is I, L or V
  MISC_FEATURE (6)..(6): X is N or Q for amidated amino acids
  MISC_FEATURE (7)..(7): X is GabaX for X2X3 or X3X2 or X2X3 or X3X2 or X3X3 or X2X2
  MISC_FEATURE (8)..(8): X is K, R or H for basic amino acids
  MISC_FEATURE (9)..(9): X is T or S
  MISC_FEATURE (10)..(10): X is N or Q for amidated amino acids
  MISC_FEATURE (11)..(11): X is N or Q for amidated amino acids
  MISC_FEATURE (12)..(12): X is T or S
  MISC_FEATURE (13)..(13): X is T or S
  MISC_FEATURE (14)..(14): X is GabaX for X2X3 or X3X2 or X2X3 or X3X2 or X3X3 or X2X2
  MISC_FEATURE (15)..(15): X is T or S
  MISC_FEATURE (16)..(16): X is T or S
  MISC_FEATURE (17)..(17): X is K, R or H for basic amino acids
XXXXXXXXXXXXXXXXX

SEQ ID NO: 770 - protein, 18 aa, Artificial
  Completely synthesized peptide construct
  MISC_FEATURE (1)..(1): X is D and E for acidic amino acids
  MISC_FEATURE (2)..(2): X is A and G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A and G
  MISC_FEATURE (8)..(8): X is A and G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A and G
  MISC_FEATURE (14)..(14): X is I, L or V
  MISC_FEATURE (15)..(15): X is I, L or V
  MISC_FEATURE (16)..(16): X is A and G
  MISC_FEATURE (17)..(17): X is A and G
  MISC_FEATURE (18)..(18): X is A and G
XXXXXXXXXXXXXXXXXX

SEQ ID NO: 771 - protein, 19 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is A and G
  MISC_FEATURE (4)..(4): X is N or Q for amidated amino acids
  MISC_FEATURE (5)..(5): X is D and E for acidic amino acids
  MISC_FEATURE (6)..(6): X is D and E for acidic amino acids
  MISC_FEATURE (7)..(7): X is K, R or H for basic amino acids
  MISC_FEATURE (8)..(8): X is A and G
  MISC_FEATURE (9)..(9): X is A and G
  MISC_FEATURE (10)..(10): X is I, L or V
  MISC_FEATURE (11)..(11): X is I, L or V
  MISC_FEATURE (12)..(12): X is C or S
  MISC_FEATURE (13)..(13): X is T or S
  MISC_FEATURE (14)..(14): X is A and G
  MISC_FEATURE (15)..(15): X is I, L or V
  MISC_FEATURE (16)..(16): X is I, L or V
  MISC_FEATURE (17)..(17): X is A and G
  MISC_FEATURE (18)..(18): X is A and G
  MISC_FEATURE (19)..(19): X is A and G
XXXXXXXXXXXXXXXXXXX

SEQ ID NO: 772 - protein, 16 aa, Artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is A and G
  MISC_FEATURE (4)..(4): X is N or Q for amidated amino acids
  MISC_FEATURE (5)..(5): X is GabaX for X2X3 or X3X2 or X2X3 or X3X2 or X3X3 or X2X2
  MISC_FEATURE (6)..(6): X is K, R or H for basic amino acids
  MISC_FEATURE (7)..(7): X is A and G
  MISC_FEATURE (8)..(8): X is A and G
  MISC_FEATURE (9)..(9): X is GabaX for X2X3 or X3X2 or X2X3 or X3X2 or X3X3 or X2X2
  MISC_FEATURE (10)..(10): X is C or S
  MISC_FEATURE (11)..(11): X is T or S
  MISC_FEATURE (12)..(12): X is A and G
  MISC_FEATURE (13)..(13): X is GabaX for X2X3 or X3X2 or X2X3 or X3X2 or X3X3 or X2X2
  MISC_FEATURE (14)..(14): X is A and G
  MISC_FEATURE (15)..(15): X is A and G
  MISC_FEATURE (16)..(16): X is A and G
XXXXXXXXXXXXXXXX

SEQ ID NO: 773 - protein, 70 aa, Homo sapiens [sequence omitted]

SEQ ID NO: 774 - protein, 18 aa, Homo sapiens [sequence omitted]

SEQ ID NO: 775 - protein, 108 aa, Homo sapiens
KKPGESLKISCQGSGYNFNTYYIAWVRHMPGYGLEWMGIIYPDDSTIRYSPSFQGQVTISADKSTTTAYLQWNSLKASDTAMYYCARRVASALSYWYFDLWGQGTLVT

SEQ ID NO: 776 - protein, 93 aa, Homo sapiens [sequence omitted]

SEQ ID NO: 777 - protein, 31 aa, Artificial; identical to SEQ ID NO: 123
  Completely synthesized peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A and G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A and G
  MISC_FEATURE (15)..(15): X is A and G
  MISC_FEATURE (16)..(16): X is A and G
  MISC_FEATURE (17)..(17): X is acetyl or propionyl group, D glycine or D alanine, cyclohexylalanine at amino terminus
  MISC_FEATURE (18)..(18): X is C or S
  MISC_FEATURE (19)..(19): X is I, L or V
  MISC_FEATURE (20)..(20): X is K, R or H for basic amino acids
  MISC_FEATURE (21)..(21): X is I, L or V
  MISC_FEATURE (22)..(22): X is M or Nle (Norleucine)
  MISC_FEATURE (23)..(23): X is A and G
  MISC_FEATURE (24)..(24): X is T or S
  MISC_FEATURE (25)..(25): X is I, L or V
  MISC_FEATURE (26)..(26): X is F or P
  MISC_FEATURE (27)..(27): X is C or S
  MISC_FEATURE (28)..(28): X is C or S
  MISC_FEATURE (29)..(29): X is F, W or Y for aromatic amino acids
  MISC_FEATURE (30)..(30): X is A and G
  MISC_FEATURE (31)..(31): X is T or S

SEQ ID NO: 778 - protein, 33 aa, Artificial
  Completely synthesized peptide construct
DGQEEKAGVVSTGLIGGGDGQEEKAGVVSTGLI

SEQ ID NO: 779 - protein, 32 aa, Artificial; identical to SEQ ID NO: 153
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is A and G
  MISC_FEATURE (4)..(4): X is N or Q for amidated amino acids
  MISC_FEATURE (5)..(5): X is GabaX for X2X3 or X3X2 or X2X3 or X3X2 or X3X3 or X2X2
  MISC_FEATURE (6)..(6): X is K, R or H for basic amino acids
  MISC_FEATURE (7)..(7): X is A and G
  MISC_FEATURE (8)..(8): X is A and G
  MISC_FEATURE (9)..(9): X is GabaX for X2X3 or X3X2 or X2X3 or X3X2 or X3X3 or X2X2
  MISC_FEATURE (10)..(10): X is C or S
  MISC_FEATURE (11)..(11): X is T or S
  MISC_FEATURE (12)..(12): X is A and G
  MISC_FEATURE (13)..(13): X is GabaX for X2X3 or X3X2 or X2X3 or X3X2 or X3X3 or X2X2
  MISC_FEATURE (14)..(14): X is A and G
  MISC_FEATURE (15)..(15): X is A and G
  MISC_FEATURE (16)..(16): X is A and G
  MISC_FEATURE (17)..(17): X is A and G
  MISC_FEATURE (18)..(18): X is acetyl or propionyl group, D glycine or D alanine, cyclohexylalanine at amino terminus
  MISC_FEATURE (19)..(19): X is C or S
  MISC_FEATURE (20)..(20): X is K, R or H for basic amino acids
  MISC_FEATURE (21)..(21): X is I, L or V
  MISC_FEATURE (22)..(22): X is I, L or V
  MISC_FEATURE (23)..(23): X is D and E for acidic amino acids
  MISC_FEATURE (24)..(24): X is A and G
  MISC_FEATURE (25)..(25): X is I, L or V
  MISC_FEATURE (26)..(26): X is F, W or Y for aromatic amino acids
  MISC_FEATURE (27)..(27): X is I, L or V
  MISC_FEATURE (28)..(28): X is C or S
  MISC_FEATURE (29)..(29): X is A and G
  MISC_FEATURE (30)..(30): X is D and E for acidic amino acids
  MISC_FEATURE (31)..(31): X is K, R or H for basic amino acids
  MISC_FEATURE (32)..(32): X is A and G

SEQ ID NO: 780 - protein, 38 aa, Artificial
  Completely synthesized peptide construct
DGQEEKAGVVSTGLIGGGDGEAGKPGKAGERGPPGPQG

SEQ ID NO: 781 - protein, 37 aa, Artificial; identical to SEQ ID NO: 151
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is A and G
  MISC_FEATURE (4)..(4): X is N or Q for amidated amino acids
  MISC_FEATURE (5)..(5): X is GabaX for X2X3 or X3X2 or X2X3 or X3X2 or X3X3 or X2X2
  MISC_FEATURE (6)..(6): X is K, R or H for basic amino acids
  MISC_FEATURE (7)..(7): X is A and G
  MISC_FEATURE (8)..(8): X is A and G
  MISC_FEATURE (9)..(9): X is GabaX for X2X3 or X3X2 or X2X3 or X3X2 or X3X3 or X2X2
  MISC_FEATURE (10)..(10): X is C or S
  MISC_FEATURE (11)..(11): X is T or S
  MISC_FEATURE (12)..(12): X is A and G
  MISC_FEATURE (13)..(13): X is GabaX for X2X3 or X3X2 or X2X3 or X3X2 or X3X3 or X2X2
  MISC_FEATURE (14)..(14): X is A and G
  MISC_FEATURE (15)..(15): X is A and G
  MISC_FEATURE (16)..(16): X is A and G
  MISC_FEATURE (17)..(17): X is A and G
  MISC_FEATURE (18)..(18): X is D and E for acidic amino acids
  MISC_FEATURE (19)..(19): X is A and G
  MISC_FEATURE (20)..(20): X is D and E for acidic amino acids
  MISC_FEATURE (21)..(21): X is A and G
  MISC_FEATURE (22)..(22): X is A and G
  MISC_FEATURE (23)..(23): X is K, R or H for basic amino acids
  MISC_FEATURE (24)..(24): X is F or P
  MISC_FEATURE (25)..(25): X is A and G
  MISC_FEATURE (26)..(26): X is K, R or H for basic amino acids
  MISC_FEATURE (27)..(27): X is A and G
  MISC_FEATURE (28)..(28): X is A and G
  MISC_FEATURE (29)..(29): X is D and E for acidic amino acids
  MISC_FEATURE (30)..(30): X is K, R or H for basic amino acids
  MISC_FEATURE (31)..(31): X is A and G
  MISC_FEATURE (32)..(32): X is F or P
  MISC_FEATURE (33)..(33): X is F or P
  MISC_FEATURE (34)..(34): X is A and G
  MISC_FEATURE (35)..(35): X is F or P
  MISC_FEATURE (36)..(36): X is N or Q for amidated amino acids
  MISC_FEATURE (37)..(37): X is A and G

SEQ ID NO: 782 - protein, 33 aa, Artificial
  Completely synthesized peptide construct
DLLKNGERIEKVEGGGSVKLSIAVKNKAEFHQS

SEQ ID NO: 783 - protein, 33 aa, Artificial; identical to SEQ ID NO: 97
  Completely synthesized peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A and G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A and G
  MISC_FEATURE (15)..(15): X is A and G
  MISC_FEATURE (16)..(16): X is A and G
  MISC_FEATURE (17)..(17): X is T or S
  MISC_FEATURE (18)..(18): X is I, L or V
  MISC_FEATURE (19)..(19): X is K, R or H for basic amino acids
  MISC_FEATURE (20)..(20): X is I, L or V
  MISC_FEATURE (21)..(21): X is T or S
  MISC_FEATURE (22)..(22): X is I, L or V
  MISC_FEATURE (23)..(23): X is A and G
  MISC_FEATURE (24)..(24): X is I, L or V
  MISC_FEATURE (25)..(25): X is K, R or H for basic amino acids
  MISC_FEATURE (26)..(26): X is N or Q for amidated amino acids
  MISC_FEATURE (27)..(27): X is K, R or H for basic amino acids
  MISC_FEATURE (28)..(28): X is A and G
  MISC_FEATURE (29)..(29): X is D and E for acidic amino acids
  MISC_FEATURE (30)..(30): X is F or P
  MISC_FEATURE (31)..(31): X is K, R or H for basic amino acids
  MISC_FEATURE (32)..(32): X is N or Q for amidated amino acids
  MISC_FEATURE (33)..(33): X is T or S

SEQ ID NO: 784 - protein, 33 aa, Artificial
  Completely synthesized peptide construct
DLLKNGERIEKVEGGGNVREGIAFRPASKTFTV

SEQ ID NO: 785 - protein, 33 aa, Artificial; identical to SEQ ID NO: 97
  Completely synthesized peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A and G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A and G
  MISC_FEATURE (15)..(15): X is A and G
  MISC_FEATURE (16)..(16): X is A and G
  MISC_FEATURE (17)..(17): X is  N or Q for amidated amino acids
  MISC_FEATURE (18)..(18): X is I, L or V
  MISC_FEATURE (19)..(19): X is K, R or H for basic amino acids
  MISC_FEATURE (20)..(20): X is D and E for acidic amino acids
  MISC_FEATURE (21)..(21): X is A and G
  MISC_FEATURE (22)..(22): X is I, L or V
  MISC_FEATURE (23)..(23): X is A and G
  MISC_FEATURE (24)..(24): X is F or P
  MISC_FEATURE (25)..(25): X is K, R or H for basic amino acids
  MISC_FEATURE (26)..(26): X is F or P
  MISC_FEATURE (27)..(27): X is A and G
  MISC_FEATURE (28)..(28): X is T or S
  MISC_FEATURE (29)..(29): X is K, R or H for basic amino acids
  MISC_FEATURE (30)..(30): X is T or S
  MISC_FEATURE (31)..(31): X is F or P
  MISC_FEATURE (32)..(32): X is T or S
  MISC_FEATURE (33)..(33): X is I, L or V

SEQ ID NO: 786 - protein, 36 aa, Artificial
  Completely synthesized peptide construct
DLLKNGERIEKVEGGGGPTHLFQPSLVLDMAKVLLD

SEQ ID NO: 787 - protein, 36 aa, Artificial; identical to SEQ ID NO: 164
  Completely synthesized peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A and G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A and G
  MISC_FEATURE (15)..(15): X is A and G
  MISC_FEATURE (16)..(16): X is A and G
  MISC_FEATURE (17)..(17): X is A and G
  MISC_FEATURE (18)..(18): X is F or P
  MISC_FEATURE (19)..(19): X is T or S
  MISC_FEATURE (20)..(20): X is K, R or H for basic amino acids
  MISC_FEATURE (21)..(21): X is I, L or V
  MISC_FEATURE (22)..(22): X is F, W or Y for aromatic amino acids
  MISC_FEATURE (23)..(23): X is N or Q for amidated amino acids
  MISC_FEATURE (24)..(24): X is F or P
  MISC_FEATURE (25)..(25): X is T or S
  MISC_FEATURE (26)..(26): X is I, L or V
  MISC_FEATURE (27)..(27): X is I, L or V
  MISC_FEATURE (28)..(28): X is I, L or V
  MISC_FEATURE (29)..(29): X is D and E for acidic amino acids
  MISC_FEATURE (30)..(30): X is M or Nle (Norleucine)
  MISC_FEATURE (31)..(31): X is A and G
  MISC_FEATURE (32)..(32): X is K, R or H for basic amino acids
  MISC_FEATURE (33)..(33): X is I, L or V
  MISC_FEATURE (34)..(34): X is I, L or V
  MISC_FEATURE (35)..(35): X is I, L or V
  MISC_FEATURE (36)..(36): X is D and E for acidic amino acids

SEQ ID NO: 788 - protein, 35 aa, artificial
  Completely synthesized peptide construct
DGQEEKAGVVSTGLIGGGSVKLSIAVKNKAEFHQS

SEQ ID NO: 789 - protein, 33 aa, artificial; identical to SEQ ID NO: 97
  Completely synthesized peptide construct
  MISC_FEATURE (1)..(1): X is acetyl or propionyl group, D glycine or D alanine, cyclohexylalanie at amino terminus
  MISC_FEATURE (2)..(2): X is D and E for acidic amino acids
  MISC_FEATURE (3)..(3): X is A and G
  MISC_FEATURE (4)..(4): X is N or Q for amidated amino acids
  MISC_FEATURE (5)..(5): X is GabaX for X2X3 or X3X2 or X2X3 or X3X2 or X3X3 or X2X2
  MISC_FEATURE (6)..(6): X is K, R or H for basic amino acids
  MISC_FEATURE (7)..(7): X is A and G
  MISC_FEATURE (8)..(8): X is A and G
  MISC_FEATURE (9)..(9): X is GabaX for X2X3 or X3X2 or X2X3 or X3X2 or X3X3 or X2X2
  MISC_FEATURE (10)..(10): X is C or S
  MISC_FEATURE (11)..(11): X is T or S
  MISC_FEATURE (12)..(12): X is A and G
  MISC_FEATURE (13)..(13): X is GabaX for X2X3 or X3X2 or X2X3 or X3X2 or X3X3 or X2X2
  MISC_FEATURE (14)..(14): X is A and G
  MISC_FEATURE (15)..(15): X is A and G
  MISC_FEATURE (16)..(16): X is A and G
  MISC_FEATURE (17)..(17): X is T or S
  MISC_FEATURE (18)..(18): X is I, L or V
  MISC_FEATURE (19)..(19): X is K, R or H for basic amino acids
  MISC_FEATURE (20)..(20): X is I, L or V
  MISC_FEATURE (21)..(21): X is T or S
  MISC_FEATURE (22)..(22): X is I, L or V
  MISC_FEATURE (23)..(23): X is A and G
  MISC_FEATURE (24)..(24): X is I, L or V
  MISC_FEATURE (25)..(25): X is K, R or H for basic amino acids
  MISC_FEATURE (26)..(26): X is N or Q for amidated amino acids
  MISC_FEATURE (27)..(27): X is K, R or H for basic amino acids
  MISC_FEATURE (28)..(28): X is A and G
  MISC_FEATURE (29)..(29): X is D and E for acidic amino acids
  MISC_FEATURE (30)..(30): X is F or P
  MISC_FEATURE (31)..(31): X is K, R or H for basic amino acids
  MISC_FEATURE (32)..(32): X is N or Q for amidated amino acids
  MISC_FEATURE (33)..(33): X is T or S

SEQ ID NO: 790 - protein, 35 aa, artificial
  Completely synthesized peptide construct
DGQEEKAGVVSTGLIGGGNVREGIAFRPASKTFTV

SEQ ID NO: 791 - protein, 33 aa, artificial; identical to SEQ ID NO: 97
  Completely synthesized peptide construct
  MISC_FEATURE (1)..(1): X is acetyl or propiionyl group, D glycine or D alanine, cyclohexylalanine at amino terminus
  MISC_FEATURE (2)..(2): X is D and E for acidic amino acids
  MISC_FEATURE (3)..(3): X is A and G
  MISC_FEATURE (4)..(4): X is N or Q for amidated amino acids
  MISC_FEATURE (5)..(5): X is GabaX for X2X3 or X3X2 or X2X3 or X3X2 or X3X3 or X2X2
  MISC_FEATURE (6)..(6): X is K, R or H for basic amino acids
  MISC_FEATURE (7)..(7): X is A and G
  MISC_FEATURE (8)..(8): X is A and G
  MISC_FEATURE (9)..(9): X is GabaX for X2X3 or X3X2 or X2X3 or X2X2 or X3X3 or X2X2
  MISC_FEATURE (10)..(10): X is C or S
  MISC_FEATURE (11)..(11): X is T or S
  MISC_FEATURE (12)..(12): X is A and G
  MISC_FEATURE (13)..(13): X is GabaX for X2X3 or X3X2 or X2X3 or X3X2 or X3X3 or X2X2
  MISC_FEATURE (14)..(14): X is A and G
  MISC_FEATURE (15)..(15): X is A and G
  MISC_FEATURE (16)..(16): X is A and G
  MISC_FEATURE (17)..(17): X is T or S
  MISC_FEATURE (18)..(18): X is I, L or V
  MISC_FEATURE (19)..(19): X is K, R or H for basic amino acids
  MISC_FEATURE (20)..(20): X is I, L or V
  MISC_FEATURE (21)..(21): X is T or S
  MISC_FEATURE (22)..(22): X is I, L or V
  MISC_FEATURE (23)..(23): X is A and G
  MISC_FEATURE (24)..(24): X is I, L or V
  MISC_FEATURE (25)..(25): X is K, R or H for basic amino acids
  MISC_FEATURE (26)..(26): X is N or Q for amidated amino acids
  MISC_FEATURE (27)..(27): X is K, R or H for basic amino acids
  MISC_FEATURE (28)..(28): X is A and G
  MISC_FEATURE (29)..(29): X is D and E for acidic amino acids
  MISC_FEATURE (30)..(30): X is F or P
  MISC_FEATURE (31)..(31): X is K, R or H for basic amino acids
  MISC_FEATURE (32)..(32): X is N or Q for amidated amino acids
  MISC_FEATURE (33)..(33): X is T or S

SEQ ID NO: 792 - protein, 38 aa, artificial
  Completely synthesized peptide construct
DGQEEKAGVVSTGLIGGGGPTHLFQPSLVLDMAKVLLD

SEQ ID NO: 793 - protein, 36 aa, artificial; identical to SEQ ID NO: 164
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is D and E for acidic amino acids
  MISC_FEATURE (3)..(3): X is A and G
  MISC_FEATURE (4)..(4): X is N or Q for amidated amino acids
  MISC_FEATURE (5)..(5): X is GabaX for X2X3 or X3X2 or X2X3 or X3X2 or X3X3 or X2X2
  MISC_FEATURE (6)..(6): X is K, R or H for basic amino acids
  MISC_FEATURE (7)..(7): X is A and G
  MISC_FEATURE (8)..(8): X is A and G
  MISC_FEATURE (9)..(9): X is GabaX for X2X3 or X3X2 or X2X3 or X3X2 or X3X3 or X2X2
  MISC_FEATURE (10)..(10): X is C or S
  MISC_FEATURE (11)..(11): X is T or S
  MISC_FEATURE (12)..(12): X is A and G
  MISC_FEATURE (13)..(13): X is GabaX for X2X3 or X3X2 or X2X3 or X3X2 or X3X3 or X2X2
  MISC_FEATURE (14)..(14): X is A and G
  MISC_FEATURE (15)..(15): X is A and G
  MISC_FEATURE (16)..(16): X is A and G
  MISC_FEATURE (17)..(17): X is A and G
  MISC_FEATURE (18)..(18): X is F or P
  MISC_FEATURE (19)..(19): X is T or S
  MISC_FEATURE (20)..(20): X is K, R or H for basic amino acids
  MISC_FEATURE (21)..(21): X is I, L or V
  MISC_FEATURE (22)..(22): X is F, W or Y for aromatic amino acids
  MISC_FEATURE (23)..(23): X is N or Q for amidated amino acids
  MISC_FEATURE (24)..(24): X is F or P
  MISC_FEATURE (25)..(25): X is T or S
  MISC_FEATURE (26)..(26): X is I, L or V
  MISC_FEATURE (27)..(27): X is I, L or V
  MISC_FEATURE (28)..(28): X is I, L or V
  MISC_FEATURE (29)..(29): x is D and E for acidic amino acids
  MISC_FEATURE (30)..(30): X is M or Nle (Norleucine)
  MISC_FEATURE (31)..(31): X is A and G
  MISC_FEATURE (32)..(32): X is K, R or H for basic amino acids
  MISC_FEATURE (33)..(33): X is I, L or V
  MISC_FEATURE (34)..(34): X is I, L or V
  MISC_FEATURE (35)..(35): X is I, L or V
  MISC_FEATURE (36)..(36): X is D and E for acidic amino acids

SEQ ID NO: 794 - protein, 23 aa, artificial
  Completely synthesized peptide construct
VQGEESNDKGGGNITEIADLTQK

SEQ ID NO: 795 - protein, 23 aa, artificial
  Completely synthesized peptide construct
  MISC_FEATURE (1)..(1): X is I, L or V
  MISC_FEATURE (2)..(2): X is N or Q for amidated amino acids
  MISC_FEATURE (3)..(3): X is A and G
  MISC_FEATURE (4)..(4): X is D and E for acidic amino acids
  MISC_FEATURE (5)..(5): X is D and E for acidic amino acids
  MISC_FEATURE (6)..(6): X is C or S
  MISC_FEATURE (7)..(7): X is N or Q for amidated amino acids
  MISC_FEATURE (8)..(8): X is D and E for acidic amino acids
  MISC_FEATURE (9)..(9): X is K, R or H for basic amino acids
  MISC_FEATURE (10)..(10): X is A and G
  MISC_FEATURE (11)..(11): X is A and G
  MISC_FEATURE (12)..(12): X is A and G
  MISC_FEATURE (13)..(13): X is N or Q for amidated amino acids
  MISC_FEATURE (14)..(14): X is I, L or V
  MISC_FEATURE (15)..(15): X is T or S
  MISC_FEATURE (16)..(16): X is D and E for acidic amino acids
  MISC_FEATURE (17)..(17): X is I, L or V
  MISC_FEATURE (18)..(18): X is A and G
  MISC_FEATURE (19)..(19): X is D and E for acidic amino acids
  MISC_FEATURE (20)..(20): X is I, L or V
  MISC_FEATURE (21)..(21): X is T or S
  MISC_FEATURE (22)..(22): X is N or Q for amidated amino acids
  MISC_FEATURE (23)..(23): X is K, R or H for basic amino acids
XXXXXXXXXXXXXXXXXXXXXXX

SEQ ID NO: 796 - protein, 27 aa, artificial
  Completely synthesized peptide construct
DLLKNGERIEKVEGGGNITEIADLTQK

SEQ ID NO: 797 - protein, 24 aa, artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is GabaX for X2X3 or X3X2 or X2X3 or X3X2 or X3X3 or X2X2
  MISC_FEATURE (3)..(3): X is K, R or H for basic amino acids
  MISC_FEATURE (4)..(4): X is N or Q for amidated amino acids
  MISC_FEATURE (5)..(5): X is A and G
  MISC_FEATURE (6)..(6): X is D and E for acidic amino acids
  MISC_FEATURE (7)..(7): X is K, R or H for basic amino acids
  MISC_FEATURE (8)..(8): X is GabaX for X2X3 or X3X2 or X2X3 or X3X2 or X3 X3 or X2X2
  MISC_FEATURE (9)..(9): X is K, R or H for basic amino acids
  MISC_FEATURE (10)..(10): X is GabaX for X2X3 or X3X2 or X2X3 or X3X2 or X3X3 or X2X2
  MISC_FEATURE (11)..(11): X is A and G
  MISC_FEATURE (12)..(12): X is A and G
  MISC_FEATURE (13)..(13): X is A and G
  MISC_FEATURE (14)..(14): X is N or Q for amidated amino acids
  MISC_FEATURE (15)..(15): X is I, L or V
  MISC_FEATURE (16)..(16): X is T or S
  MISC_FEATURE (17)..(17): X is D and E for acidic amino acids
  MISC_FEATURE (18)..(18): X is I, L or V
  MISC_FEATURE (19)..(19): X is A and G
  MISC_FEATURE (20)..(20): X is D and E for acidic amino acids
  MISC_FEATURE (21)..(21): X is I, L or V
  MISC_FEATURE (22)..(22): X is T or S
  MISC_FEATURE (23)..(23): X is N or Q for amidated amino acids
  MISC_FEATURE (24)..(24): X is K, R or H for basic amino acids
XXXXXXXXXXXXXXXXXXXXXXXX

SEQ ID NO: 798 - protein, 32 aa, artificial
  Completely synthesized peptide construct
VQGEESNDKGGGGPTHLFQPSLVLDMAKVLLD

SEQ ID NO: 799 - protein, 30 aa, artificial; identical to SEQ ID NO: 56
  Completely synthesized peptide construct
  MISC_FEATURE (1)..(1): X is I, L or V
  MISC_FEATURE (2)..(2): X is N or Q for amidated amino acids
  MISC_FEATURE (3)..(3): X is A and G
  MISC_FEATURE (4)..(4): X is D and E for acidic amino acids
  MISC_FEATURE (5)..(5): X is D and E for acidic amino acids
  MISC_FEATURE (6)..(6): X is C or S
  MISC_FEATURE (7)..(7): X is N or Q for amidated amino acids
  MISC_FEATURE (8)..(8): X is D and E for acidic amino acids
  MISC_FEATURE (9)..(9): X is K, R or H for basic amino acids
  MISC_FEATURE (10)..(10): X is A and G
  MISC_FEATURE (11)..(11): X is A and G
  MISC_FEATURE (12)..(12): X is A and G
  MISC_FEATURE (13)..(13): X is A and G
  MISC_FEATURE (14)..(14): X is F or P
  MISC_FEATURE (15)..(15): X is T or S
  MISC_FEATURE (16)..(16): X is K, R or H for basic amino acids
  MISC_FEATURE (17)..(17): X is I, L or V
  MISC_FEATURE (18)..(18): X is F, W or Y for aromatic amino acids
  MISC_FEATURE (19)..(19): X is N or Q for amidated amino acids
  MISC_FEATURE (20)..(20): X is F or P
  MISC_FEATURE (21)..(21): X is T or S
  MISC_FEATURE (22)..(22): X is I, L or V
  MISC_FEATURE (23)..(23): X is I, L or V
  MISC_FEATURE (24)..(24): X is I, L or V
  MISC_FEATURE (25)..(25): X is D and E for acidic amino acids
  MISC_FEATURE (26)..(26): X is M or Nle (Norleucine)
  MISC_FEATURE (27)..(27): X is A and G
  MISC_FEATURE (28)..(28): X is K, R or H for basic amino acids
  MISC_FEATURE (29)..(29): X is 5-aminopentanoic acid for replacement of 3 or 4 amino acids of X2 or X3
  MISC_FEATURE (30)..(30): X is D and E for acidic amino acids

SEQ ID NO: 800 - protein, 31 aa, artificial
  Completely synthesized peptide construct
DLLKNGERIEKVEGGGDGQEEKAGVVSTGLI

SEQ ID NO: 801 - protein, 24 aa, artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is GabaX for X2X3 or X3X2 or X2X3 or X3X2 or X3X3 or X2X2
  MISC_FEATURE (3)..(3): X is K, R or H for basic amino acids
  MISC_FEATURE (4)..(4): X is N or Q for amidated amino acids
  MISC_FEATURE (5)..(5): X is A and G
  MISC_FEATURE (6)..(6): X is D and E for acidic amino acids
  MISC_FEATURE (7)..(7): X is K, R or H for basic amino acids
  MISC_FEATURE (8)..(8): X is GabaX for X2X3 or X3X2 or X2X3 or X3X2 or X3X3 or X2X2
  MISC_FEATURE (9)..(9): X is K, R or H for basic amino acids
  MISC_FEATURE (10)..(10): X is GabaX for X2X3 or X3X2 or X2X3 or X3X2 or X3X3 or X2X2
  MISC_FEATURE (11)..(11): X is A and G
  MISC_FEATURE (12)..(12): X is A and G
  MISC_FEATURE (13)..(13): X is A and G
  MISC_FEATURE (14)..(14): X is N or Q for amidated amino acids
  MISC_FEATURE (15)..(15): X is I, L or V
  MISC_FEATURE (16)..(16): X is T or S
  MISC_FEATURE (17)..(17): X is D and E for acidic amino acids
  MISC_FEATURE (18)..(18): X is I, L or V
  MISC_FEATURE (19)..(19): X is A and G
  MISC_FEATURE (20)..(20): D and E for acidic amino acids
  MISC_FEATURE (21)..(21): X is I, L or V
  MISC_FEATURE (22)..(22): X is T or S
  MISC_FEATURE (23)..(23): X is N or Q for amidated amino acids
  MISC_FEATURE (24)..(24): X is K, R or H for basic amino acids
XXXXXXXXXXXXXXXXXXXXXXXX

SEQ ID NO: 802 - protein, 27 aa, artificial
  Completely synthesized peptide construct
VQGEESNDKGGGDGQEEKAGVVSTGLI

SEQ ID NO: 803 - protein, 23 aa, artificial
  Completely synthesized peptide construct
  MISC_FEATURE (1)..(1): X is I, L or V
  MISC_FEATURE (2)..(2): X is N or Q for amidated amino acids
  MISC_FEATURE (3)..(3): X is A and G
  MISC_FEATURE (4)..(4): X is D and E for acidic amino acids
  MISC_FEATURE (5)..(5): X is D and E for acidic amino acids
  MISC_FEATURE (6)..(6): X is C or S
  MISC_FEATURE (7)..(7): X is N or Q for amidated amino acids
  MISC_FEATURE (8)..(8): X is D and E for acidic amino acids
  MISC_FEATURE (9)..(9): X is K, R or H for basic amino acids
  MISC_FEATURE (10)..(10): X is A and G
  MISC_FEATURE (11)..(11): X is A and G
  MISC_FEATURE (12)..(12): X is A and G
  MISC_FEATURE (13)..(13): X is N or Q for amidated amino acids
  MISC_FEATURE (14)..(14): X is I, L or V
  MISC_FEATURE (15)..(15): X is T or S
  MISC_FEATURE (16)..(16): X is D and E for acidic amino acids
  MISC_FEATURE (17)..(17): X is I, L or V
  MISC_FEATURE (18)..(18): X is A and G
  MISC_FEATURE (19)..(19): X is D and E for acidic amino acids
  MISC_FEATURE (20)..(20): X is I, L or V
  MISC_FEATURE (21)..(21): X is T or S
  MISC_FEATURE (22)..(22): X is N or Q for amidated amino acids
  MISC_FEATURE (23)..(23): X is K, R or H for basic amino acids
XXXXXXXXXXXXXXXXXXXXXXX

SEQ ID NO: 804 - protein, 34 aa, artificial
  Completely synthesized peptide construct
DLLKNGERIEKVEGGGSVDRSGNVHHQFQKLTLE

SEQ ID NO: 805 - protein, 121 aa, artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is GabaX for X2X3 or X3X2 or X2X3 or X3X2 or X3X3 or X2X2
  MISC_FEATURE (3)..(3): X is K, R or H for basic amino acids
  MISC_FEATURE (4)..(4): X is N or Q for amidated amino acids
  MISC_FEATURE (5)..(5): X is A and G
  MISC_FEATURE (6)..(6): X is D and E for acidic amino acids
  MISC_FEATURE (7)..(7): X is K, R or H for basic amino acids
  MISC_FEATURE (8)..(8): X is GabaX for X2X3 or X3X2 or X2X3 or X3X2 or X3X3 or X2X2
  MISC_FEATURE (9)..(9): X is K, R or H for basic amino acids
  MISC_FEATURE (10)..(10): X is GabaX for X2X3 or X3X2 or X2X3 or X3X2 or X3X3 or X2X2
  MISC_FEATURE (11)..(11): X is A and G
  MISC_FEATURE (12)..(12): X is A and G
  MISC_FEATURE (13)..(13): X is A and G
XXXXXXXXXXXXXKKPGESLKISCQGSGYNFNTYYIAWVRHMPGYGLEWMGIIYPDDSTIRYSPSFQGQVTISADKSTTTAYLQWNSLKASDTAMYYCARRVASALSYWYFDLWGQGTLVT

SEQ ID NO: 806 - protein, 36 aa, artificial
  Completely synthesized peptide construct
DGQEEKAGVVSTGLIGGGSVDRSGNVHHQFQKLTLE

SEQ ID NO: 807 - protein, 95 aa, artificial
  Completely synthesized peptide construct
LVWKKQKDKVAELENSEGGGLEWMGIIYPDDSTIRYSPSFQGQVTISADKSTTTAYLQWNSLKASDTAMYYCARRVASALSYWYFDLWGQGTLVT

SEQ ID NO: 808 - protein, 30 aa, artificial
  Completely synthesized peptide construct
VQGEESNDKGGGSVDRSGNVHHQFQKLTLE

SEQ ID NO: 809 - protein, 88 aa, artificial
  Completely synthesized peptide construct
  MISC_FEATURE (1)..(1): X is acetyl or propionyl group, D glycine or D alanine, cyclohexylalanine at amino terminus
  MISC_FEATURE (2)..(2): X is I, L or V
  MISC_FEATURE (3)..(3): X is N or Q for amidated amino acids
  MISC_FEATURE (4)..(4): X is A and G
  MISC_FEATURE (5)..(5): X is D and E for acidic amino acids
  MISC_FEATURE (6)..(6): X is D and E for acidic amino acids
  MISC_FEATURE (7)..(7): X is C or S
  MISC_FEATURE (8)..(8): X is N or Q for amidated amino acids
  MISC_FEATURE (9)..(9): X is D and E for acidic amino acids
  MISC_FEATURE (10)..(10): X is K, R or H for basic amino acids
  MISC_FEATURE (11)..(11): X is A and G
  MISC_FEATURE (12)..(12): X is A and G
  MISC_FEATURE (13)..(13): X is A and G
XXXXXXXXXXXXXLEWMGIIYPDDSTIRYSPSFQGQVTISADKSTTTAYLQWNSLKASDTAMYYCARRVASALSYWYFDLWGQGTLVT

SEQ ID NO: 810 - protein, 28 aa, artificial
  Completely synthesized peptide construct
DQTQDTEGGGSVDRSGNVHHQFQKLTLE

SEQ ID NO: 811 - protein, 30 aa, artificial
  Completely synthesized peptide construct
AYMTMKIRNGGGSVDRSGNVHHQFQKLTLE

SEQ ID NO: 812 - protein, 20 aa, Homo sapiens
TGGKPGIAGFKGEQGPKGEP

SEQ ID NO: 813 - protein, 20 aa, artificial
  Completely synthesized peptide construct
  MISC_FEATURE (1)..(1): X is T or S
  MISC_FEATURE (2)..(2): X is A and G
  MISC_FEATURE (3)..(3): X is A and G
  MISC_FEATURE (4)..(4): X is K, R or H for basic amino acids
  MISC_FEATURE (5)..(5): X is F or P
  MISC_FEATURE (6)..(6): X is A and G
  MISC_FEATURE (7)..(7): X is I, L or V
  MISC_FEATURE (8)..(8): X is A and G
  MISC_FEATURE (9)..(9): X is A and G
  MISC_FEATURE (10)..(10): X is F, W or Y for aromatic amino acids
  MISC_FEATURE (11)..(11): X is K, R or H for basic amino acids
  MISC_FEATURE (12)..(12): X is A and G
  MISC_FEATURE (13)..(13): X is D and E for acidic amino acids
  MISC_FEATURE (14)..(14): X is N or Q for amidated amino acids
  MISC_FEATURE (15)..(15): X is A and G
  MISC_FEATURE (16)..(16): X is F or P
  MISC_FEATURE (17)..(17): X is K, R or H for basic amino acids
  MISC_FEATURE (18)..(18): X is A and G
  MISC_FEATURE (19)..(19): X is D and E for acidic amino acids
  MISC_FEATURE (20)..(20): X is F or P
XXXXXXXXXXXXXXXXXXXX

SEQ ID NO: 814 - protein, 15 aa, artificial
  Completely synthesized peptide construct
  MISC_FEATURE (1)..(1): X is T or S
  MISC_FEATURE (2)..(2): X is X1X1 or X1X3 or X3X1 or X1X2 or X2X1
  MISC_FEATURE (3)..(3): X is K, R or H for basic amino acids
  MISC_FEATURE (4)..(4): X is F or P
  MISC_FEATURE (5)..(5): X is GabaX for X2X3 or X3X2 or X2X3 or X3X2 or X3X3 or X2X2
  MISC_FEATURE (5)..(5): X is Gaba for X2X3 or X3X2 or X2X3 or X3X2 or X3X3 or X2X2
  MISC_FEATURE (6)..(6): X is X1X1 or X1X3 or X3X1 or X1X2 or X2X1
  MISC_FEATURE (7)..(7): X is F, W or Y for aromatic amino acids
  MISC_FEATURE (8)..(8): X is K, R or H for basic amino acids
  MISC_FEATURE (9)..(9): X is X1X1 or X1X3 or X3X1 or X1X2 or X2X1
  MISC_FEATURE (10)..(10): X is N or Q for amidated amino acids
  MISC_FEATURE (11)..(11): X is A and G
  MISC_FEATURE (12)..(12): X is F or P
  MISC_FEATURE (13)..(13): X is K, R or H for basic amino acids
  MISC_FEATURE (14)..(14): X is X1X1 or X1X3 or X3X1 or X1X2 or X2X1
  MISC_FEATURE (15)..(15): X is F or P
XXXXXXXXXXXXXXX

SEQ ID NO: 815 - protein, 34 aa, artificial
  Completely synthesized peptide construct
PSTHVLITHTIGGGTGGKPGIAGFKGEQGPKGEP

SEQ ID NO: 816 - protein, 38 aa, artificial
  Completely synthesized peptide construct
DFLPHYKNTSLGHRPGGGTGGKPGIAGFKGEQGPKGEP

SEQ ID NO: 817 - protein, 40 aa, artificial
  Completely synthesized peptide construct
NGQEEKAGVVSTGLIGGGGSTGGKPGIAGFKGEQGPKGEP

SEQ ID NO: 818 - protein, 40 aa, artificial
  Completely synthesized peptide construct
DGQEEKAGVVSTGLIGGGGSTGGKPGIAGFKGEQGPKGEP

SEQ ID NO: 819 - protein, 38 aa, artificial
  Completely synthesized peptide construct
DGQEEKAGVVSTGLIGGGTGGKPGIAGFKGEQGPKGEP

SEQ ID NO: 820 - protein, 38 aa, artificial; identical to SEQ ID NO: 162
  Completely synthesized peptide construct
  MISC_FEATURE (1)..(1): X is D and E for acidic amino acids
  MISC_FEATURE (2)..(2): X is A and G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A and G
  MISC_FEATURE (8)..(8): X is A and G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A and G
  MISC_FEATURE (14)..(14): X is I, L or V
  MISC_FEATURE (15)..(15): X is I, L or V
  MISC_FEATURE (16)..(16): X is A and G
  MISC_FEATURE (17)..(17): X is A and G
  MISC_FEATURE (18)..(18): X is A and G
  MISC_FEATURE (19)..(19): X is T or S
  MISC_FEATURE (20)..(20): X is A and G
  MISC_FEATURE (21)..(21): X is A and G
  MISC_FEATURE (22)..(22): X is K, R or H for basic amino acids
  MISC_FEATURE (23)..(23): X is F or P
  MISC_FEATURE (24)..(24): X is A and G
  MISC_FEATURE (25)..(25): X is I, L or V
  MISC_FEATURE (26)..(26): X is A and G
  MISC_FEATURE (27)..(27): X is A and G
  MISC_FEATURE (28)..(28): X is F, W or Y for aromatic amino acids
  MISC_FEATURE (29)..(29): X is K, R or H for basic amino acids
  MISC_FEATURE (30)..(30): X is A and G
  MISC_FEATURE (31)..(31): X is D and E for acidic amino acids
  MISC_FEATURE (32)..(32): X is N or Q for amidated amino acids
  MISC_FEATURE (33)..(33): X is A and G
  MISC_FEATURE (34)..(34): X is F or P
  MISC_FEATURE (35)..(35): X is K, R or H for basic amino acids
  MISC_FEATURE (36)..(36): X is A and G
  MISC_FEATURE (37)..(37): X is D and E for acidic amino acids
  MISC_FEATURE (38)..(38): X is F or P

SEQ ID NO: 821 - protein, 39 aa, artificial; identical to SEQ ID NO: 176
  Completely synthesized peptide construct
  MISC_FEATURE (1)..(1): X is Acetyl or propionyl group, D glycine or D alanine, Cyclohexylalanine at amino terminus
  MISC_FEATURE (2)..(2): X is D and E for acidic amino acids
  MISC_FEATURE (3)..(3): X is A and G
  MISC_FEATURE (4)..(4): X is N or Q for amidated amino acids
  MISC_FEATURE (5)..(5): X is D and E for acidic amino acids
  MISC_FEATURE (6)..(6): X is D and E for acidic amino acids
  MISC_FEATURE (7)..(7): X is K, R or H for basic amino acids
  MISC_FEATURE (8)..(8): X is A and G
  MISC_FEATURE (9)..(9): X is A and G
  MISC_FEATURE (10)..(10): X is I, L or V
  MISC_FEATURE (11)..(11): X is I, L or V
  MISC_FEATURE (12)..(12): X is C or S
  MISC_FEATURE (13)..(13): X is T or S
  MISC_FEATURE (14)..(14): X is A and G
  MISC_FEATURE (15)..(15): X is I, L or V
  MISC_FEATURE (16)..(16): X is I, L or V
  MISC_FEATURE (17)..(17): X is A and G
  MISC_FEATURE (18)..(18): X is A and G
  MISC_FEATURE (19)..(19): X is A and G
  MISC_FEATURE (20)..(20): X is T or S
  MISC_FEATURE (21)..(21): X is A and G
  MISC_FEATURE (22)..(22): X is A and G
  MISC_FEATURE (23)..(23): X is K, R or H for basic amino acids
  MISC_FEATURE (24)..(24): X is F or P
  MISC_FEATURE (25)..(25): X is A and G
  MISC_FEATURE (26)..(26): X is I, L or V
  MISC_FEATURE (27)..(27): X is A and G
  MISC_FEATURE (28)..(28): X is A and G
  MISC_FEATURE (29)..(29): X is F, W or Y for aromatic amino acids
  MISC_FEATURE (30)..(30): X is K, R or H for basic amino acids
  MISC_FEATURE (31)..(31): X is A and G
  MISC_FEATURE (32)..(32): X is D and E for acidic amino acids
  MISC_FEATURE (33)..(33): X is N or Q for amidated amino acids
  MISC_FEATURE (34)..(34): X is A and G
  MISC_FEATURE (35)..(35): X is F or P
  MISC_FEATURE (36)..(36): X is K, R or H for basic amino acids
  MISC_FEATURE (37)..(37): X is A and G
  MISC_FEATURE (38)..(38): X is D and E for acidic amino acids
  MISC_FEATURE (39)..(39): X is F or P

SEQ ID NO: 822 - protein, 39 aa, artificial; identical to SEQ ID NO: 176
  Completely synthesized peptide construct
  MISC_FEATURE (1)..(1): X is 5-aminopentanoic acid for replacement of 3 or 4 amino acids of X2 and  X3
  MISC_FEATURE (2)..(2): X is D and E for acidic amino acids
  MISC_FEATURE (3)..(3): X is A and G
  MISC_FEATURE (4)..(4): X is N or Q for amidated amino acids
  MISC_FEATURE (5)..(5): X is D and E for acidic amino acids
  MISC_FEATURE (6)..(6): X is D and E for acidic amino acids
  MISC_FEATURE (7)..(7): X is K, R or H for basic amino acids
  MISC_FEATURE (8)..(8): X is A and G
  MISC_FEATURE (9)..(9): X is A and G
  MISC_FEATURE (10)..(10): X is I, L or V
  MISC_FEATURE (11)..(11): X is I, L or V
  MISC_FEATURE (12)..(12): X is C or S
  MISC_FEATURE (13)..(13): X is T or S
  MISC_FEATURE (14)..(14): X is A and G
  MISC_FEATURE (15)..(15): X is I, L or V
  MISC_FEATURE (16)..(16): X is I, L or V
  MISC_FEATURE (17)..(17): X is A and G
  MISC_FEATURE (18)..(18): X is A and G
  MISC_FEATURE (19)..(19): X is A and G
  MISC_FEATURE (20)..(20): X is T or S
  MISC_FEATURE (21)..(21): X is A and G
  MISC_FEATURE (22)..(22): X is A and G
  MISC_FEATURE (23)..(23): X is K, R or H for basic amino acids
  MISC_FEATURE (24)..(24): X is F or P
  MISC_FEATURE (25)..(25): X is A and G
  MISC_FEATURE (26)..(26): X is I, L or V
  MISC_FEATURE (27)..(27): X is A and G
  MISC_FEATURE (28)..(28): X is A and G
  MISC_FEATURE (29)..(29): X is F, W or Y for aromatic amino acids
  MISC_FEATURE (30)..(30): X is K, R or H for basic amino acids
  MISC_FEATURE (31)..(31): X is A and G
  MISC_FEATURE (32)..(32): X is D and E for acidic amino acids
  MISC_FEATURE (33)..(33): X is N or Q for amidated amino acids
  MISC_FEATURE (34)..(34): X is A and G
  MISC_FEATURE (35)..(35): X is F or P
  MISC_FEATURE (36)..(36): X is K, R or H for basic amino acids
  MISC_FEATURE (37)..(37): X is A and G
  MISC_FEATURE (38)..(38): X is D and E for acidic amino acids
  MISC_FEATURE (39)..(39): X is F or P

SEQ ID NO: 823 - protein, 36 aa, artificial; identical to SEQ ID NO: 164
  Completely synthesized peptide construct
  MISC_FEATURE (1)..(1): X is Acetyl or propionyl group, D glycine or D alanine, Cyclohexylalanine at amino terminus
  MISC_FEATURE (2)..(2): X is D and E for acidic amino acids
  MISC_FEATURE (3)..(3): X is A and G
  MISC_FEATURE (4)..(4): X is N or Q for amidated amino acids
  MISC_FEATURE (5)..(5): X is Gaba for X2X3 or X3X2 or X2X3 or X3X2 or X3X3 or X2X2
  MISC_FEATURE (6)..(6): X is K, R or H for basic amino acids
  MISC_FEATURE (7)..(7): X is A and G
  MISC_FEATURE (8)..(8): X is A and G
  MISC_FEATURE (9)..(9): X is Gaba for X2X3 or X3X2 or X2X3 or X3X2 or X3X3 or X2X2
  MISC_FEATURE (10)..(10): X is C or S
  MISC_FEATURE (11)..(11): X is T or S
  MISC_FEATURE (12)..(12): X is A and G
  MISC_FEATURE (13)..(13): X is Gaba for X2X3 or X3X2 or X2X3 or X3X2 or X3X3 or X2X2
  MISC_FEATURE (14)..(14): X is A and G
  MISC_FEATURE (15)..(15): X is A and G
  MISC_FEATURE (16)..(16): X is A and G
  MISC_FEATURE (17)..(17): X is T or S
  MISC_FEATURE (18)..(18): X is A and G
  MISC_FEATURE (19)..(19): X is A and G
  MISC_FEATURE (20)..(20): X is K, R or H for basic amino acids
  MISC_FEATURE (21)..(21): X is F or P
  MISC_FEATURE (22)..(22): X is A and G
  MISC_FEATURE (23)..(23): X is I, L or V
  MISC_FEATURE (24)..(24): X is A and G
  MISC_FEATURE (25)..(25): X is A and G
  MISC_FEATURE (26)..(26): X is F, W or Y for aromatic amino acids
  MISC_FEATURE (27)..(27): X is K, R or H for basic amino acids
  MISC_FEATURE (28)..(28): X is A and G
  MISC_FEATURE (29)..(29): X is D and E for acidic amino acids
  MISC_FEATURE (30)..(30): X is N or Q for amidated amino acids
  MISC_FEATURE (31)..(31): X is A and G
  MISC_FEATURE (32)..(32): X is F or P
  MISC_FEATURE (33)..(33): X is K, R or H for basic amino acids
  MISC_FEATURE (34)..(34): X is A and G
  MISC_FEATURE (35)..(35): X is D and E for acidic amino acids
  MISC_FEATURE (36)..(36): X is F or P

SEQ ID NO: 824 - protein, 33 aa, artificial; identical to SEQ ID NO: 97
  Completely synthesized peptide construct
  MISC_FEATURE (1)..(1): X is D and E for acidic amino acids
  MISC_FEATURE (2)..(2): X is A and G
  MISC_FEATURE (3)..(3): X is N or Q for amidated amino acids
  MISC_FEATURE (4)..(4): X is D and E for acidic amino acids
  MISC_FEATURE (5)..(5): X is D and E for acidic amino acids
  MISC_FEATURE (6)..(6): X is K, R or H for basic amino acids
  MISC_FEATURE (7)..(7): X is A and G
  MISC_FEATURE (8)..(8): X is A and G
  MISC_FEATURE (9)..(9): X is I, L or V
  MISC_FEATURE (10)..(10): X is I, L or V
  MISC_FEATURE (11)..(11): X is C or S
  MISC_FEATURE (12)..(12): X is T or S
  MISC_FEATURE (13)..(13): X is A and G
  MISC_FEATURE (14)..(14): X is I, L or V
  MISC_FEATURE (15)..(15): X is I, L or V
  MISC_FEATURE (16)..(16): X is A and G
  MISC_FEATURE (17)..(17): X is A and G
  MISC_FEATURE (18)..(18): X is A and G
  MISC_FEATURE (19)..(19): X is T or S
  MISC_FEATURE (20)..(20): X is X1X1 or X1X3 or X3X1 or X1X2 or X2X1
  MISC_FEATURE (21)..(21): X is K, R or H for basic amino acids
  MISC_FEATURE (22)..(22): X is F or P
  MISC_FEATURE (23)..(23): X is Gaba for X2 X3 or X3 X2 or X2X3 or X3X2 or X3X3 or X2X2
  MISC_FEATURE (24)..(24): X is X1X1 or X1X3 or X3X1 or X1X2 or X2X1
  MISC_FEATURE (25)..(25): X is F, W or Y for aromatic amino acids
  MISC_FEATURE (26)..(26): X is K, R or H for basic amino acids
  MISC_FEATURE (27)..(27): X is X1X1 or X1X3 or X3X1 or X1X2 or X2X1
  MISC_FEATURE (28)..(28): X is N or Q for amidated amino acids
  MISC_FEATURE (29)..(29): X is A and G
  MISC_FEATURE (30)..(30): X is F or P
  MISC_FEATURE (31)..(31): X is K, R or H for basic amino acids
  MISC_FEATURE (32)..(32): X is X1X1 or X1X3 or X3X1 or X1X2 or X2X1
  MISC_FEATURE (33)..(33): X is F or P

SEQ ID NO: 825 - protein, 34 aa, artificial; identical to SEQ ID NO: 77
  Completely synthesized peptide construct
  MISC_FEATURE (1)..(1): X is Acetyl or propionyl group, D glycine or D alanine, Cyclohexylalanine at amino terminus
  MISC_FEATURE (2)..(2): X is D and E for acidic amino acids
  MISC_FEATURE (3)..(3): X is A and G
  MISC_FEATURE (4)..(4): X is N or Q for amidated amino acids
  MISC_FEATURE (5)..(5): X is D and E for acidic amino acids
  MISC_FEATURE (6)..(6): X is D and E for acidic amino acids
  MISC_FEATURE (7)..(7): X is K, R or H for basic amino acids
  MISC_FEATURE (8)..(8): X is A and G
  MISC_FEATURE (9)..(9): X is A and G
  MISC_FEATURE (10)..(10): X is I, L or V
  MISC_FEATURE (11)..(11): X is I, L or V
  MISC_FEATURE (12)..(12): X is C or S
  MISC_FEATURE (13)..(13): X is T or S
  MISC_FEATURE (14)..(14): X is A and G
  MISC_FEATURE (15)..(15): X is I, L or V
  MISC_FEATURE (16)..(16): X is I, L or V
  MISC_FEATURE (17)..(17): X is A and G
  MISC_FEATURE (18)..(18): X is A and G
  MISC_FEATURE (19)..(19): X is A and G
  MISC_FEATURE (20)..(20): X is T or S
  MISC_FEATURE (21)..(21): X is X1X1 or X1X3 or X3X1 or X1X2 or X2X1
  MISC_FEATURE (22)..(22): X is K, R or H for basic amino acids
  MISC_FEATURE (23)..(23): X is F or P
  MISC_FEATURE (24)..(24): X is Gaba for X2X3 or X3X2 or X2X3 or X3X2 or X3X3 or X2X2
  MISC_FEATURE (25)..(25): X is X1X1 or X1X3 or X3X1 or X1X2 or X2X1
  MISC_FEATURE (26)..(26): X is F, W or Y for aromatic amino acids
  MISC_FEATURE (27)..(27): X is K, R or H for basic amino acids
  MISC_FEATURE (28)..(28): X is X1X1 or X1X3 or X3X1 or X1X2 or X2X1
  MISC_FEATURE (29)..(29): X is N or Q for amidated amino acids
  MISC_FEATURE (30)..(30): X is A and G
  MISC_FEATURE (31)..(31): X is F or P
  MISC_FEATURE (32)..(32): X is K, R or H for basic amino acids
  MISC_FEATURE (33)..(33): X is X1X1 or X1X3 or X3X1 or X1X2 or X2X1
  MISC_FEATURE (34)..(34): X is F or P

SEQ ID NO: 826 - protein, 34 aa, artificial; identical to SEQ ID NO: 77
  Completely synthesized peptide construct
  MISC_FEATURE (1)..(1): X is 5-aminopentanoic acid for replacement of 3 or 4 amino acids of X2 and  X3
  MISC_FEATURE (2)..(2): X is D and E for acidic amino acids
  MISC_FEATURE (3)..(3): X is A and G
  MISC_FEATURE (4)..(4): X is N or Q for amidated amino acids
  misc_feature (5)..(5): Xaa can be any naturally occurring amino acid
  MISC_FEATURE (6)..(6): X is D and E for acidic amino acids
  MISC_FEATURE (7)..(7): X is K, R or H for basic amino acids
  MISC_FEATURE (8)..(8): X is A and G
  MISC_FEATURE (9)..(9): X is A and G
  MISC_FEATURE (10)..(10): X is A and G
  MISC_FEATURE (11)..(11): X is I, L or V
  MISC_FEATURE (12)..(12): X is C or S
  MISC_FEATURE (13)..(13): X is T or S
  MISC_FEATURE (14)..(14): X is A and G
  MISC_FEATURE (15)..(15): X is I, L or V
  MISC_FEATURE (16)..(16): X is I, L or V
  misc_feature (17)..(17): Xaa can be any naturally occurring amino acid
  MISC_FEATURE (18)..(18): X is A and G
  MISC_FEATURE (19)..(19): X is A and G
  MISC_FEATURE (20)..(20): X is T or S
  MISC_FEATURE (21)..(21): X is X1X1 or X1X3 or X3X1 or X1X2 or X2X1
  MISC_FEATURE (22)..(22): X is K, R or H for basic amino acids
  MISC_FEATURE (23)..(23): X is F or P
  MISC_FEATURE (24)..(24): X is Gaba for X2X3 or X3X2 or X2X3 pr X3X2 or X3X3 or X2X2
  MISC_FEATURE (25)..(25): X is X1X1 or X1X3 or X3X1 or X1X2 or X2X1
  MISC_FEATURE (26)..(26): X is F, W or Y for aromatic amino acids
  MISC_FEATURE (27)..(27): X is K, R or H for basic amino acids
  MISC_FEATURE (28)..(28): X is X1X1 or X1X3 or X3X1 or X1X2 or X2X1
  MISC_FEATURE (29)..(29): X is N or Q for amidated amino acids
  MISC_FEATURE (30)..(30): X is A and G
  MISC_FEATURE (31)..(31): X is F or P
  MISC_FEATURE (32)..(32): X is K, R or H for basic amino acids
  MISC_FEATURE (33)..(33): X is X1X1 or X1X3 or X3X1 or X1X2 or X2X1
  MISC_FEATURE (34)..(34): X is F or P

SEQ ID NO: 827 - protein, 31 aa, artificial; identical to SEQ ID NO: 123
  Completely synthesized peptide construct
  MISC_FEATURE (1)..(1): X is Acetyl or propionyl group, D glycine or D alanine, Cyclohexylalanine at amino terminus
  MISC_FEATURE (2)..(2): X is D and E for acidic amino acids
  MISC_FEATURE (3)..(3): X is A and G
  MISC_FEATURE (4)..(4): X is N or Q for amidated amino acids
  MISC_FEATURE (5)..(5): X is Gaba for X2X3 or X3X3 or X2X3 or X3X2 or X3X3 or X2X2
  MISC_FEATURE (6)..(6): X is K, R or H for basic amino acids
  MISC_FEATURE (7)..(7): X is A and G
  MISC_FEATURE (8)..(8): X is A and G
  MISC_FEATURE (9)..(9): X is Gaba for X2X3 or X3X3 or X2X3 or X3X2 or X3X3 or X2X2
  MISC_FEATURE (10)..(10): X is C or S
  MISC_FEATURE (11)..(11): X is T or S
  MISC_FEATURE (12)..(12): X is A and G
  MISC_FEATURE (13)..(13): X is Gaba for X2X3 or X3X3 or X2X3 or X3X2 or X3X3 or X2X2
  MISC_FEATURE (14)..(14): X is A and G
  MISC_FEATURE (15)..(15): X is A and G
  MISC_FEATURE (16)..(16): X is A and G
  MISC_FEATURE (17)..(17): X is T or S
  MISC_FEATURE (18)..(18): X is X1X1 or X1X3 or X3X1 or X1X2 or X2X1
  MISC_FEATURE (19)..(19): X is K, R or H for basic amino acids
  MISC_FEATURE (20)..(20): X is F or P
  MISC_FEATURE (21)..(21): X is Gaba for X2X3 or X3X3 or X2X3 or X3X2 or X3X3 or X2X2
  MISC_FEATURE (22)..(22): X is X is X1X1 or X1X3 or X3X1 or X1X2 or X2X1
  MISC_FEATURE (23)..(23): X is F, W or Y for aromatic amino acids
  MISC_FEATURE (24)..(24): X is K, R or H for basic amino acids
  MISC_FEATURE (25)..(25): X is X is X1X1 or X1X3 or X3X1 or X1X2 or X2X1
  MISC_FEATURE (26)..(26): X is N or Q for amidated amino acids
  MISC_FEATURE (27)..(27): X is A and G
  MISC_FEATURE (28)..(28): X is F or P
  MISC_FEATURE (29)..(29): X is K, R or H for basic amino acids
  MISC_FEATURE (30)..(30): X is X is X1X1 or X1X3 or X3X1 or X1X2 or X2X1
  MISC_FEATURE (31)..(31): X is F or P

SEQ ID NO: 828 - protein, 36 aa, Artificial Sequence
  Heteroconjugate construct
DLLKNGERIEKVEGGGTGGKPGIAGFKGEQGPKGEP

SEQ ID NO: 829 - protein, 36 aa, artificial; identical to SEQ ID NO: 164
  Completely synthesized peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A and G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A and G
  MISC_FEATURE (15)..(15): X is A and G
  MISC_FEATURE (16)..(16): X is A and G
  MISC_FEATURE (17)..(17): X is T or S
  MISC_FEATURE (18)..(18): X is A and G
  MISC_FEATURE (19)..(19): X is A and G
  MISC_FEATURE (20)..(20): X is K, R or H for basic amino acids
  MISC_FEATURE (21)..(21): X is F or P
  MISC_FEATURE (22)..(22): X is A and G
  MISC_FEATURE (23)..(23): X is I, L or V
  MISC_FEATURE (24)..(24): X is A and G
  MISC_FEATURE (25)..(25): X is A and G
  MISC_FEATURE (26)..(26): X is F, W or Y for aromatic amino acids
  MISC_FEATURE (27)..(27): X is K, R or H for basic amino acids
  MISC_FEATURE (28)..(28): X is A and G
  MISC_FEATURE (29)..(29): X is D and E for acidic amino acids
  MISC_FEATURE (30)..(30): X is N or Q for amidated amino acids
  MISC_FEATURE (31)..(31): X is A and G
  MISC_FEATURE (32)..(32): X is F or P
  MISC_FEATURE (33)..(33): X is K, R or H for basic amino acids
  MISC_FEATURE (34)..(34): X is A and G
  MISC_FEATURE (35)..(35): X is D and E for acidic amino acids
  MISC_FEATURE (36)..(36): X is F or P

SEQ ID NO: 830 - protein, 37 aa, artificial; identical to SEQ ID NO: 151
  Completely synthesized peptide construct
  MISC_FEATURE (1)..(1): X is Acetyl or propionyl group, D glycine or D alanine, Cyclohexylalanine at amino terminus
  MISC_FEATURE (2)..(2): X is D and E for acidic amino acids
  MISC_FEATURE (3)..(3): X is I, L or V
  MISC_FEATURE (4)..(4): X is I, L or V
  MISC_FEATURE (5)..(5): X is K, R or H for basic amino acids
  MISC_FEATURE (6)..(6): X is N or Q for amidated amino acids
  MISC_FEATURE (7)..(7): X is A and G
  MISC_FEATURE (8)..(8): X is D and E for acidic amino acids
  MISC_FEATURE (9)..(9): X is K, R or H for basic amino acids
  MISC_FEATURE (10)..(10): X is I, L or V
  MISC_FEATURE (11)..(11): X is D and E for acidic amino acids
  MISC_FEATURE (12)..(12): X is K, R or H for basic amino acids
  MISC_FEATURE (13)..(13): X is I, L or V
  MISC_FEATURE (14)..(14): X is D and E for acidic amino acids
  MISC_FEATURE (15)..(15): X is A and G
  MISC_FEATURE (16)..(16): X is A and G
  MISC_FEATURE (17)..(17): X is A and G
  MISC_FEATURE (18)..(18): X is T or S
  MISC_FEATURE (19)..(19): X is A and G
  MISC_FEATURE (20)..(20): X is A and G
  MISC_FEATURE (21)..(21): X is K, R or H for basic amino acids
  MISC_FEATURE (22)..(22): X is F or P
  MISC_FEATURE (23)..(23): X is A and G
  MISC_FEATURE (24)..(24): X is I, L or V
  MISC_FEATURE (25)..(25): X is A and G
  MISC_FEATURE (26)..(26): X is A and G
  MISC_FEATURE (27)..(27): X is F, W or Y for aromatic amino acids
  MISC_FEATURE (28)..(28): X is K, R or H for basic amino acids
  MISC_FEATURE (29)..(29): X is A and G
  MISC_FEATURE (30)..(30): X is D and E for acidic amino acids
  MISC_FEATURE (31)..(31): X is N or Q for amidated amino acids
  MISC_FEATURE (32)..(32): X is A and G
  MISC_FEATURE (33)..(33): X is F or P
  MISC_FEATURE (34)..(34): X is K, R or H for basic amino acids
  MISC_FEATURE (35)..(35): X is A and G
  MISC_FEATURE (36)..(36): X is D and E for acidic amino acids
  MISC_FEATURE (37)..(37): X is F or P

SEQ ID NO: 831 - protein, 33 aa, artificial; identical to SEQ ID NO: 97
  Completely synthesized peptide construct
  MISC_FEATURE (1)..(1): X is Acetyl or propionyl group, D glycine or D alanine, Cyclohexylalanine at amino terminus
  MISC_FEATURE (2)..(2): X is Gaba for X2X3 or X3X2 or X2X3 or X3X2 or X3X3 or X2X2
  MISC_FEATURE (3)..(3): X is K, R or H for basic amino acids
  MISC_FEATURE (4)..(4): X is N or Q for amidated amino acids
  MISC_FEATURE (5)..(5): X is A and G
  MISC_FEATURE (6)..(6): X is D and E for acidic amino acids
  MISC_FEATURE (7)..(7): X is K, R or H for basic amino acids
  MISC_FEATURE (8)..(8): X is Gaba for X2X3 or X3X2 or X2X3 or X3X2 or X3X3 or X2X2
  MISC_FEATURE (9)..(9): X is K, R or H for basic amino acids
  MISC_FEATURE (10)..(10): X is Gaba for X2X3 or X3X2 or X2X3 or X3X2 or X3X3 or X2X2
  MISC_FEATURE (11)..(11): X is A and G
  MISC_FEATURE (12)..(12): X is A and G
  MISC_FEATURE (13)..(13): X is A and G
  MISC_FEATURE (14)..(14): X is T or S
  MISC_FEATURE (15)..(15): X is A and G
  MISC_FEATURE (16)..(16): X is A and G
  MISC_FEATURE (17)..(17): X is K, R or H for basic amino acids
  MISC_FEATURE (18)..(18): X is F or P
  MISC_FEATURE (19)..(19): X is A and G
  MISC_FEATURE (20)..(20): X is I, L or V
  MISC_FEATURE (21)..(21): X is A and G
  MISC_FEATURE (22)..(22): X is A and G
  MISC_FEATURE (23)..(23): X is F, W or Y for aromatic amino acids
  MISC_FEATURE (24)..(24): X is K, R or H for basic amino acids
  MISC_FEATURE (25)..(25): X is A and G
  MISC_FEATURE (26)..(26): X is D and E for acidic amino acids
  MISC_FEATURE (27)..(27): X is N or Q for amidated amino acids
  MISC_FEATURE (28)..(28): X is A and G
  MISC_FEATURE (29)..(29): X is F or P
  MISC_FEATURE (30)..(30): X is K, R or H for basic amino acids
  MISC_FEATURE (31)..(31): X is A and G
  MISC_FEATURE (32)..(32): X is D and E for acidic amino acids
  MISC_FEATURE (33)..(33): X is F or P

SEQ ID NO: 832 - protein, 33 aa, artificial; identical to SEQ ID NO: 97
  Completely synthesized peptide construct
  MISC_FEATURE (1)..(1): X is Acetyl or propionyl group, D glycine or D alanine, Cyclohexylalanine at amino terminus
  MISC_FEATURE (2)..(2): X is 5-aminopentanoic acid for replacement of 3 or 4 amino acids of X2 and  X3
  MISC_FEATURE (3)..(3): X is K, R or H for basic amino acids
  MISC_FEATURE (4)..(4): X is N or Q for amidated amino acids
  MISC_FEATURE (5)..(5): X is A and G
  MISC_FEATURE (6)..(6): X is D and E for acidic amino acids
  MISC_FEATURE (7)..(7): X is K, R or H for basic amino acids
  MISC_FEATURE (8)..(8): X is Gaba for X2X3 or X3X2 or X2X3 or X3X2 or X3X3 or X2X2
  MISC_FEATURE (9)..(9): X is K, R or H for basic amino acids
  MISC_FEATURE (10)..(10): X is Gaba for X2X3 or X3X2 or X2X3 or X3X2 or X3X3 or X2X2
  MISC_FEATURE (11)..(11): X is A and G
  MISC_FEATURE (12)..(12): X is A and G
  MISC_FEATURE (13)..(13): X is A and G
  MISC_FEATURE (14)..(14): X is T or S
  MISC_FEATURE (15)..(15): X is A and G
  MISC_FEATURE (16)..(16): X is A and G
  MISC_FEATURE (17)..(17): X is K, R or H for basic amino acids
  MISC_FEATURE (18)..(18): X is F or P
  MISC_FEATURE (19)..(19): X is A and G
  MISC_FEATURE (20)..(20): X is I, L or V
  MISC_FEATURE (21)..(21): X is A and G
  MISC_FEATURE (22)..(22): X is A and G
  MISC_FEATURE (23)..(23): X is F, W or Y for aromatic amino acids
  MISC_FEATURE (24)..(24): X is K, R or H for basic amino acids
  MISC_FEATURE (25)..(25): X is A and G
  MISC_FEATURE (26)..(26): X is D and E for acidic amino acids
  MISC_FEATURE (27)..(27): X is N or Q for amidated amino acids
  MISC_FEATURE (28)..(28): X is A and G
  MISC_FEATURE (29)..(29): X is F or P
  MISC_FEATURE (30)..(30): X is K, R or H for basic amino acids
  MISC_FEATURE (31)..(31): X is A and G
  MISC_FEATURE (32)..(32): X is D and E for acidic amino acids
  MISC_FEATURE (33)..(33): X is F or P

SEQ ID NO: 833 - protein, 31 aa, artificial; identical to SEQ ID NO: 123
  Completely synthesized peptide construct
  MISC_FEATURE (1)..(1): X is D and E for acidic amino acids
  MISC_FEATURE (2)..(2): X is I, L or V
  MISC_FEATURE (3)..(3): X is I, L or V
  MISC_FEATURE (4)..(4): X is K, R or H for basic amino acids
  MISC_FEATURE (5)..(5): X is N or Q for amidated amino acids
  MISC_FEATURE (6)..(6): X is A and G
  MISC_FEATURE (7)..(7): X is D and E for acidic amino acids
  MISC_FEATURE (8)..(8): X is K, R or H for basic amino acids
  MISC_FEATURE (9)..(9): X is I, L or V
  MISC_FEATURE (10)..(10): X is D and E for acidic amino acids
  MISC_FEATURE (11)..(11): X is K, R or H for basic amino acids
  MISC_FEATURE (12)..(12): X is I, L or V
  MISC_FEATURE (13)..(13): X is D and E for acidic amino acids
  MISC_FEATURE (14)..(14): X is A and G
  MISC_FEATURE (15)..(15): X is A and G
  MISC_FEATURE (16)..(16): X is A and G
  MISC_FEATURE (17)..(17): X is T or S
  MISC_FEATURE (18)..(18): X is X1X1 or X1X3 or X3X1 or X1X2 or X2X1
  MISC_FEATURE (19)..(19): X is K, R or H for basic amino acids
  MISC_FEATURE (20)..(20): X is F or P
  MISC_FEATURE (21)..(21): X is Gaba for X2X3 or X3X2 or X2X3 or X3X2 or X3X3 or X2X2
  MISC_FEATURE (22)..(22): X is X1X1 or X1X3 or X3X1 or X1X2 or X2X1
  MISC_FEATURE (23)..(23): X is F, W or Y for aromatic amino acids
  MISC_FEATURE (24)..(24): X is K, R or H for basic amino acids
  MISC_FEATURE (25)..(25): X is X1X1 or X1X3 or X3X1 or X1X2 or X2X1
  MISC_FEATURE (26)..(26): X is N or Q for amidated amino acids
  MISC_FEATURE (27)..(27): X is A and G
  MISC_FEATURE (28)..(28): X is F or P
  MISC_FEATURE (29)..(29): X is K, R or H for basic amino acids
  MISC_FEATURE (30)..(30): X is X1X1 or X1X3 or X3X1 or X1X2 or X2X1
  MISC_FEATURE (31)..(31): X is F or P

SEQ ID NO: 834 - protein, 32 aa, artificial; identical to SEQ ID NO: 153
  Completely synthesized peptide construct
  MISC_FEATURE (1)..(1): X is Acetyl or propionyl group, D glycine or D alanine, Cyclohexylalanine at amino terminus
  MISC_FEATURE (2)..(2): X is D and E for acidic amino acids
  MISC_FEATURE (3)..(3): X is I, L or V
  MISC_FEATURE (4)..(4): X is I, L or V
  MISC_FEATURE (5)..(5): X is K, R or H for basic amino acids
  MISC_FEATURE (6)..(6): X is N or Q for amidated amino acids
  MISC_FEATURE (7)..(7): X is A and G
  MISC_FEATURE (8)..(8): X is D and E for acidic amino acids
  MISC_FEATURE (9)..(9): X is K, R or H for basic amino acids
  MISC_FEATURE (10)..(10): X is I, L or V
  MISC_FEATURE (11)..(11): X is D and E for acidic amino acids
  MISC_FEATURE (12)..(12): X is K, R or H for basic amino acids
  MISC_FEATURE (13)..(13): X is I, L or V
  MISC_FEATURE (14)..(14): X is D and E for acidic amino acids
  MISC_FEATURE (15)..(15): X is A and G
  MISC_FEATURE (16)..(16): X is A and G
  MISC_FEATURE (17)..(17): X is A and G
  MISC_FEATURE (18)..(18): X is T or S
  MISC_FEATURE (19)..(19): X is X1X1 or X1X3 or X3X1 or X1X2 or X2X1
  MISC_FEATURE (20)..(20): X is K, R or H for basic amino acids
  MISC_FEATURE (21)..(21): X is F or P
  MISC_FEATURE (22)..(22): X is Gaba for X2X3 or X3X2 or X2X3 or X3X2 or X3X3 or X2X2
  MISC_FEATURE (23)..(23): X is X1X1 or X1X3 or X3X1 or X1X2 or X2X1
  MISC_FEATURE (24)..(24): X is F, W or Y for aromatic amino acids
  MISC_FEATURE (25)..(25): X is K, R or H for basic amino acids
  MISC_FEATURE (26)..(26): X is X1X1 or X1X3 or X3X1 or X1X2 or X2X1
  MISC_FEATURE (27)..(27): X is N or Q for amidated amino acids
  MISC_FEATURE (28)..(28): X is A and G
  MISC_FEATURE (29)..(29): X is F or P
  MISC_FEATURE (30)..(30): X is K, R or H for basic amino acids
  MISC_FEATURE (31)..(31): X is X1X1 or X1X3 or X3X1 or X1X2 or X2X1
  MISC_FEATURE (32)..(32): X is F or P

SEQ ID NO: 835 - protein, 27 aa, artificial
  Completely synthesized peptide construct
  MISC_FEATURE (1)..(1): X is Acetyl or propionyl group, D glycine or D alanine, Cyclohexylalanine at amino terminus
  MISC_FEATURE (2)..(2): X is Gaba for X2X3 or X3X2 or X2X3 or X3X2 or X3X3 or X2X2
  MISC_FEATURE (3)..(3): X is K, R or H for basic amino acids
  MISC_FEATURE (4)..(4): X is N or Q for amidated amino acids
  MISC_FEATURE (5)..(5): X is A and G
  MISC_FEATURE (6)..(6): X is D and E for acidic amino acids
  MISC_FEATURE (7)..(7): X is K, R or H for basic amino acids
  MISC_FEATURE (8)..(8): X is Gaba for X2X3 or X3X2 or X2X3 or X3X2 or X3X3 or X2X2
  MISC_FEATURE (9)..(9): X is K, R or H for basic amino acids
  MISC_FEATURE (10)..(10): X is Gaba for X2X3 or X3X2 or X2X3 or X3X2 or X3X3 or X2X2
  MISC_FEATURE (11)..(11): X is A and G
  MISC_FEATURE (12)..(12): X is A and G
  MISC_FEATURE (13)..(13): X is A and G
  MISC_FEATURE (14)..(14): X is T or S
  MISC_FEATURE (15)..(15): X is X1X1 or X1X3 or X3X1 or X1X2 or X2X1
  MISC_FEATURE (16)..(16): X is K, R or H for basic amino acids
  MISC_FEATURE (17)..(17): X is F or P
  MISC_FEATURE (18)..(18): X is Gaba for X2X3 or X3X2 or X2X3 or X3X2 or X3X3 or X2X2
  MISC_FEATURE (19)..(19): X is X1X1 or X1X3 or X3X1 or X1X2 or X2X1
  MISC_FEATURE (20)..(20): X is F, W or Y for aromatic amino acids
  MISC_FEATURE (21)..(21): X is K, R or H for basic amino acids
  MISC_FEATURE (22)..(22): X is X1X1 or X1X3 or X3X1 or X1X2 or X2X1
  MISC_FEATURE (23)..(23): X is N or Q for amidated amino acids
  MISC_FEATURE (24)..(24): X is A and G
  MISC_FEATURE (25)..(25): X is F or P
  MISC_FEATURE (26)..(26): X is K, R or H for basic amino acids
  MISC_FEATURE (27)..(27): X is X1X1 or X1X3 or X3X1 or X1X2 or X2X1
  MISC_FEATURE (28)..(28): X is F or P
XXXXXXXXXXXXXXXXXXXXXXXXXXX

SEQ ID NO: 836 - protein, 28 aa, artificial
  Completely synthesized peptide construct
  MISC_FEATURE (1)..(1): X is Acetyl or propionyl group, D glycine or D alanine, Cyclohexylalanine at amino terminus
  MISC_FEATURE (2)..(2): X is 5-aminopentanoic acid for replacement of 3 or 4 amino acids of X2 and  X3
  MISC_FEATURE (3)..(3): X is K, R or H for basic amino acids
  MISC_FEATURE (4)..(4): X is N or Q for amidated amino acids
  MISC_FEATURE (5)..(5): X is A and G
  MISC_FEATURE (6)..(6): X is D and E for acidic amino acids
  MISC_FEATURE (7)..(7): X is K, R or H for basic amino acids
  MISC_FEATURE (8)..(8): X is Gaba for X2X3 or X3X2 or X2X3 or X3X2 or X3X3 or X2X2
  MISC_FEATURE (9)..(9): X is K, R or H for basic amino acids
  MISC_FEATURE (10)..(10): X is Gaba for X2X3 or X3X2 or X2X3 or X3X2 or X3X3 or X2X2
  MISC_FEATURE (11)..(11): X is A and G
  MISC_FEATURE (12)..(12): X is A and G
  MISC_FEATURE (13)..(13): X is A and G
  MISC_FEATURE (14)..(14): X is T or S
  MISC_FEATURE (15)..(15): X is X1X1 or X1X3 or X3X1 or X1X2 or X2X1
  MISC_FEATURE (16)..(16): X is K, R or H for basic amino acids
  MISC_FEATURE (17)..(17): X is F or P
  MISC_FEATURE (18)..(18): X is Gaba for X2X3 or X3X2 or X2X3 or X3X2 or X3X3 or X2X2
  MISC_FEATURE (19)..(19): X is X1X1 or X1X3 or X3X1 or X1X2 or X2X1
  MISC_FEATURE (20)..(20): X is F, W or Y for aromatic amino acids
  MISC_FEATURE (21)..(21): X is K, R or H for basic amino acids
  MISC_FEATURE (22)..(22): X is X1X1 or X1X3 or X3X1 or X1X2 or X2X1
  MISC_FEATURE (23)..(23): X is N or Q for amidated amino acids
  MISC_FEATURE (24)..(24): X is A and G
  MISC_FEATURE (25)..(25): X is F or P
  MISC_FEATURE (26)..(26): X is K, R or H for basic amino acids
  MISC_FEATURE (27)..(27): X is X1X1 or X1X3 or X3X1 or X1X2 or X2X1
  MISC_FEATURE (28)..(28): X is F or P
XXXXXXXXXXXXXXXXXXXXXXXXXXXX

SEQ ID NO: 837 - protein, 38 aa, artificial
  Completely synthesized peptide construct
TGGKPGIAGFKGEQGPKGEPGGGDGQEEKAGVVSTGLI

SEQ ID NO: 838 - protein, 38 aa, artificial; identical to SEQ ID NO: 162
  Completely synthesized peptide construct
  MISC_FEATURE (1)..(1): X is T or S
  MISC_FEATURE (2)..(2): X is A and G
  MISC_FEATURE (3)..(3): X is A and G
  MISC_FEATURE (4)..(4): X is K, R or H for basic amino acids
  MISC_FEATURE (5)..(5): X is F or P
  MISC_FEATURE (6)..(6): X is A and G
  MISC_FEATURE (7)..(7): X is I, L or V
  MISC_FEATURE (8)..(8): X is A and G
  MISC_FEATURE (9)..(9): X is A and G
  MISC_FEATURE (10)..(10): X is F, W or Y for aromatic amino acids
  MISC_FEATURE (11)..(11): X is K, R or H for basic amino acids
  MISC_FEATURE (12)..(12): X is A and G
  MISC_FEATURE (13)..(13): X is D and E for acidic amino acids
  MISC_FEATURE (14)..(14): X is N or Q for amidated amino acids
  MISC_FEATURE (15)..(15): X is A and G
  MISC_FEATURE (16)..(16): X is F or P
  MISC_FEATURE (17)..(17): X is K, R or H for basic amino acids
  MISC_FEATURE (18)..(18): X is A and G
  MISC_FEATURE (19)..(19): X is D and E for acidic amino acids
  MISC_FEATURE (20)..(20): X is F or P
  MISC_FEATURE (21)..(21): X is A and G
  MISC_FEATURE (22)..(22): X is A and G
  MISC_FEATURE (23)..(23): X is A and G
  MISC_FEATURE (24)..(24): X is D and E for acidic amino acids
  MISC_FEATURE (25)..(25): X is A and G
  MISC_FEATURE (26)..(26): X is N or Q for amidated amino acids
  MISC_FEATURE (27)..(27): X is D and E for acidic amino acids
  MISC_FEATURE (28)..(28): X is D and E for acidic amino acids
  MISC_FEATURE (29)..(29): X is K, R or H for basic amino acids
  MISC_FEATURE (30)..(30): X is A and G
  MISC_FEATURE (31)..(31): X is A and G
  MISC_FEATURE (32)..(32): X is I, L or V
  MISC_FEATURE (33)..(33): X is I, L or V
  MISC_FEATURE (34)..(34): X is C or S
  MISC_FEATURE (35)..(35): X is T or S
  MISC_FEATURE (36)..(36): X is A and G
  MISC_FEATURE (37)..(37): X is I, L or V
  MISC_FEATURE (38)..(38): X is I, L or V

SEQ ID NO: 839 - protein, 39 aa, artificial; identical to SEQ ID NO: 176
  Completely synthesized peptide construct
  MISC_FEATURE (1)..(1): X is T or S
  MISC_FEATURE (2)..(2): X is A and G
  MISC_FEATURE (3)..(3): X is A and G
  MISC_FEATURE (4)..(4): X is K, R or H for basic amino acids
  MISC_FEATURE (5)..(5): X is F or P
  MISC_FEATURE (6)..(6): X is A and G
  MISC_FEATURE (7)..(7): X is I, L or V
  MISC_FEATURE (8)..(8): X is A and G
  MISC_FEATURE (9)..(9): X is A and G
  MISC_FEATURE (10)..(10): X is F, W or Y for aromatic amino acids
  MISC_FEATURE (11)..(11): X is K, R or H for basic amino acids
  MISC_FEATURE (12)..(12): X is A and G
  MISC_FEATURE (13)..(13): X is D and E for acidic amino acids
  MISC_FEATURE (14)..(14): X is N or Q for amidated amino acids
  MISC_FEATURE (15)..(15): X is A and G
  MISC_FEATURE (16)..(16): X is F or P
  MISC_FEATURE (17)..(17): X is K, R or H for basic amino acids
  MISC_FEATURE (18)..(18): X is A and G
  MISC_FEATURE (19)..(19): X is D and E for acidic amino acids
  MISC_FEATURE (20)..(20): X is F or P
  misc_feature (21)..(21): Xaa can be any naturally occurring amino acid
  MISC_FEATURE (22)..(22): X is A and G
  MISC_FEATURE (23)..(23): X is A and G
  MISC_FEATURE (24)..(24): X is Acetyl or propionyl group, D glycine or D alanine, Cyclohexylalanine at amino terminus
  MISC_FEATURE (25)..(25): X is D and E for acidic amino acids
  MISC_FEATURE (26)..(26): X is A and G
  MISC_FEATURE (27)..(27): X is N or Q for amidated amino acids
  MISC_FEATURE (28)..(28): X is D and E for acidic amino acids
  MISC_FEATURE (29)..(29): X is D and E for acidic amino acids
  MISC_FEATURE (30)..(30): X is K, R or H for basic amino acids
  MISC_FEATURE (31)..(31): X is A and G
  MISC_FEATURE (32)..(32): X is A and G
  MISC_FEATURE (33)..(33): X is I, L or V
  MISC_FEATURE (34)..(34): X is I, L or V
  MISC_FEATURE (35)..(35): X is C or S
  MISC_FEATURE (36)..(36): X is T or S
  MISC_FEATURE (37)..(37): X is A and G
  MISC_FEATURE (38)..(38): X is I, L or V
  MISC_FEATURE (39)..(39): X is I, L or V

SEQ ID NO: 840 - protein, 39 aa, artificial; identical to SEQ ID NO: 176
  Completely synthesized peptide construct
  MISC_FEATURE (1)..(1): X is T or S
  MISC_FEATURE (2)..(2): X is A and G
  MISC_FEATURE (3)..(3): X is A and G
  MISC_FEATURE (4)..(4): X is K, R or H for basic amino acids
  MISC_FEATURE (5)..(5): X is F or P
  MISC_FEATURE (6)..(6): X is A and G
  MISC_FEATURE (7)..(7): X is I, L or V
  MISC_FEATURE (8)..(8): X is A and G
  MISC_FEATURE (9)..(9): X is A and G
  MISC_FEATURE (10)..(10): X is F, W or Y for aromatic amino acids
  MISC_FEATURE (11)..(11): X is K, R or H for basic amino acids
  MISC_FEATURE (12)..(12): X is A and G
  MISC_FEATURE (13)..(13): X is D and E for acidic amino acids
  MISC_FEATURE (14)..(14): X is N or Q for amidated amino acids
  MISC_FEATURE (15)..(15): X is A and G
  MISC_FEATURE (16)..(16): X is F or P
  MISC_FEATURE (17)..(17): X is K, R or H for basic amino acids
  MISC_FEATURE (18)..(18): X is A and G
  MISC_FEATURE (19)..(19): X is D and E for acidic amino acids
  MISC_FEATURE (20)..(20): X is F or P
  MISC_FEATURE (21)..(21): X is A and G
  MISC_FEATURE (22)..(22): X is A and G
  MISC_FEATURE (23)..(23): X is A and G
  MISC_FEATURE (24)..(24): X is 5-aminopentanoic acid for replacement of 3 or 4 amino acids of X2 and  X3
  MISC_FEATURE (25)..(25): X is D and E for acidic amino acids
  MISC_FEATURE (26)..(26): X is A and G
  MISC_FEATURE (27)..(27): X is N or Q for amidated amino acids
  MISC_FEATURE (28)..(28): X is D and E for acidic amino acids
  MISC_FEATURE (29)..(29): X is D and E for acidic amino acids
  MISC_FEATURE (30)..(30): X is K, R or H for basic amino acids
  MISC_FEATURE (31)..(31): X is A and G
  MISC_FEATURE (32)..(32): X is A and G
  MISC_FEATURE (33)..(33): X is I, L or V
  MISC_FEATURE (34)..(34): X is I, L or V
  MISC_FEATURE (35)..(35): X is C or S
  MISC_FEATURE (36)..(36): X is T or S
  MISC_FEATURE (37)..(37): X is A and G
  misc_feature (38)..(38): Xaa can be any naturally occurring amino acid
  MISC_FEATURE (39)..(39): X is I, L or V

SEQ ID NO: 841 - protein, 36 aa, artificial; identical to SEQ ID NO: 164
  Completely synthesized peptide construct
  MISC_FEATURE (1)..(1): X is T or S
  MISC_FEATURE (2)..(2): X is A and G
  MISC_FEATURE (3)..(3): X is A and G
  MISC_FEATURE (4)..(4): X is K, R or H for basic amino acids
  MISC_FEATURE (5)..(5): X is F or P
  MISC_FEATURE (6)..(6): X is A and G
  MISC_FEATURE (7)..(7): X is I, L or V
  MISC_FEATURE (8)..(8): X is A and G
  MISC_FEATURE (9)..(9): X is A and G
  MISC_FEATURE (10)..(10): X is F, W or Y for aromatic amino acids
  MISC_FEATURE (11)..(11): X is K, R or H for basic amino acids
  MISC_FEATURE (12)..(12): X is A and G
  MISC_FEATURE (13)..(13): X is D and E for acidic amino acids
  MISC_FEATURE (14)..(14): X is N or Q for amidated amino acids
  MISC_FEATURE (15)..(15): X is A and G
  MISC_FEATURE (16)..(16): X is F or P
  MISC_FEATURE (17)..(17): X is K, R or H for basic amino acids
  MISC_FEATURE (18)..(18): X is A and G
  MISC_FEATURE (19)..(19): X is D and E for acidic amino acids
  MISC_FEATURE (20)..(20): X is F or P
  MISC_FEATURE (21)..(21): X is A and G
  MISC_FEATURE (22)..(22): X is A and G
  MISC_FEATURE (23)..(23): X is A and G
  MISC_FEATURE (24)..(24): X is Acetyl or propionyl group, D glycine or D alanine, Cyclohexylalanine at amino terminus
  MISC_FEATURE (25)..(25): X is D and E for acidic amino acids
  MISC_FEATURE (26)..(26): X is A and G
  MISC_FEATURE (27)..(27): X is N or Q for amidated amino acids
  MISC_FEATURE (28)..(28): X is Gaba for X2X3 or X3X2 or X2X3 or X3X2 or X3X3 or X2X2
  MISC_FEATURE (29)..(29): X is K, R or H for basic amino acids
  MISC_FEATURE (30)..(30): X is A and G
  MISC_FEATURE (31)..(31): X is A and G
  MISC_FEATURE (32)..(32): X is Gaba for X2X3 or X3X2 or X2X3 or X3X2 or X3X3 or X2X2
  MISC_FEATURE (33)..(33): X is C or S
  MISC_FEATURE (34)..(34): X is Tor S
  MISC_FEATURE (35)..(35): X is A and G
  MISC_FEATURE (36)..(36): X is Gaba for X2X3 or X3X2 or X2X3 or X3X2 or X3X3 or X2X2

SEQ ID NO: 842 - protein, 33 aa, artificial; identical to SEQ ID NO: 97
  Completely synthesized peptide construct
  MISC_FEATURE (1)..(1): X is T or S
  MISC_FEATURE (2)..(2): X is X1X1 or X1X3 or X3X1 or X1X2 or X2X1
  MISC_FEATURE (3)..(3): X is K, R or H for basic amino acids
  MISC_FEATURE (4)..(4): X is F or P
  MISC_FEATURE (5)..(5): X is Gaba for X2X3 or X3X2 or X2X3 or X3X2 or X3X3 or X2X2
  MISC_FEATURE (6)..(6): X is X1X1 or X1X3 or X3X1 or X1X2 or X2X1
  MISC_FEATURE (7)..(7): X is F, W or Y for aromatic amino acids
  MISC_FEATURE (8)..(8): X is K, R or H for basic amino acids
  MISC_FEATURE (9)..(9): X is X1X1 or X1X3 or X3X1 or X1X2 or X2X1
  MISC_FEATURE (10)..(10): X is N or Q for amidated amino acids
  MISC_FEATURE (11)..(11): X is A and G
  MISC_FEATURE (12)..(12): X is F or P
  MISC_FEATURE (13)..(13): X is K, R or H for basic amino acids
  MISC_FEATURE (14)..(14): X is X1X1 or X1X3 or X3X1 or X1X2 or X2X1
  MISC_FEATURE (15)..(15): X is F or P
  MISC_FEATURE (16)..(16): X is A and G
  MISC_FEATURE (17)..(17): X is A and G
  MISC_FEATURE (18)..(18): X is A and G
  MISC_FEATURE (19)..(19): X is D and E for acidic amino acids
  MISC_FEATURE (20)..(20): X is A and g
  MISC_FEATURE (21)..(21): X is N or Q for amidated amino acids
  MISC_FEATURE (22)..(22): X is D and E for acidic amino acids
  MISC_FEATURE (23)..(23): X is D and E for acidic amino acids
  MISC_FEATURE (24)..(24): X is K, R or H for basic amino acids
  MISC_FEATURE (25)..(25): X is A and G
  MISC_FEATURE (26)..(26): X is A and G
  MISC_FEATURE (27)..(27): X is I, L or V
  MISC_FEATURE (28)..(28): X is I, L or V
  MISC_FEATURE (29)..(29): X is C or S
  MISC_FEATURE (30)..(30): X is T or S
  MISC_FEATURE (31)..(31): X is A and G
  MISC_FEATURE (32)..(32): X is I, L or V
  MISC_FEATURE (33)..(33): X is I, L or V

SEQ ID NO: 843 - protein, 34 aa, artificial; identical to SEQ ID NO: 77
  Completely synthesized peptide construct
  MISC_FEATURE (1)..(1): X is T or S
  MISC_FEATURE (2)..(2): X is X1X1 or X1X3 or X3X1 or X1X2 or X2X1
  MISC_FEATURE (3)..(3): X is K, R or H for basic amino acids
  MISC_FEATURE (4)..(4): X is F or P
  MISC_FEATURE (5)..(5): X is Gaba for X2X3 or X3X2 or X2X3 or X3X2 or X3X3 or X2X2
  MISC_FEATURE (6)..(6): X is X1X1 or X1X3 or X3X1 or X1X2 or X2X1
  MISC_FEATURE (7)..(7): X is F, W or Y for aromatic amino acids
  MISC_FEATURE (8)..(8): X is K, R or H for basic amino acids
  MISC_FEATURE (9)..(9): X is X1X1 or X1X3 or X3X1 or X1X2 or X2X1
  MISC_FEATURE (10)..(10): X is N or Q for amidated amino acids
  MISC_FEATURE (11)..(11): X is A and G
  MISC_FEATURE (12)..(12): X is F or P
  MISC_FEATURE (13)..(13): X is K, R or H for basic amino acids
  MISC_FEATURE (14)..(14): X is X1X1 or X1X3 or X3X1 or X1X2 or X2X1
  MISC_FEATURE (15)..(15): X is F or P
  MISC_FEATURE (16)..(16): X is A and G
  MISC_FEATURE (17)..(17): X is A and G
  MISC_FEATURE (18)..(18): X is A and G
  MISC_FEATURE (19)..(19): X is Acetyl or propionyl group, D glycine or D alanine, Cyclohexylalanine at amino terminus
  MISC_FEATURE (20)..(20): X is D and E for acidic amino acids
  MISC_FEATURE (21)..(21): X is A and G
  MISC_FEATURE (22)..(22): X is N or Q for amidated amino acids
  MISC_FEATURE (23)..(23): X is D and E for acidic amino acids
  MISC_FEATURE (24)..(24): X is D and E for acidic amino acids
  MISC_FEATURE (25)..(25): X is K, R or H for basic amino acids
  MISC_FEATURE (26)..(26): X is A and G
  MISC_FEATURE (27)..(27): X is A and G
  MISC_FEATURE (28)..(28): X is I, L or V
  MISC_FEATURE (29)..(29): X is I, L or V
  MISC_FEATURE (30)..(30): X is C or S
  MISC_FEATURE (31)..(31): X is T or S
  MISC_FEATURE (32)..(32): X is A and G
  MISC_FEATURE (33)..(33): X is I, L or V
  MISC_FEATURE (34)..(34): X is I, L or V

SEQ ID NO: 844 - protein, 33 aa, artificial; identical to SEQ ID NO: 97
  Completely synthesized peptide construct
  MISC_FEATURE (1)..(1): X is T or S
  MISC_FEATURE (2)..(2): X is X1X1 or X1X3 or X3X1 or X1X2 or X2X1
  MISC_FEATURE (3)..(3): X is K, R or H for basic amino acids
  MISC_FEATURE (4)..(4): X is F or P
  MISC_FEATURE (5)..(5): X is Gaba for X2X3 or X3X2 or X2X3 or X3X2 or X3X3 or X2X2
  MISC_FEATURE (6)..(6): X is X1X1 or X1X3 or X3X1 or X1X2 or X2X1
  MISC_FEATURE (7)..(7): X is F, W or Y for aromatic amino acids
  MISC_FEATURE (8)..(8): X is K, R or H for basic amino acids
  MISC_FEATURE (9)..(9): X is X1X1 or X1X3 or X3X1 or X1X2 or X2X1
  MISC_FEATURE (10)..(10): X is N or Q for amidated amino acids
  MISC_FEATURE (11)..(11): X is A and G
  MISC_FEATURE (12)..(12): X is F or P
  MISC_FEATURE (13)..(13): X is K, R or H for basic amino acids
  MISC_FEATURE (14)..(14): X is X1X1 or X1X3 or X3X1 or X1X2 or X2X1
  MISC_FEATURE (15)..(15): X is F or P
  MISC_FEATURE (16)..(16): X is A and G
  MISC_FEATURE (17)..(17): X is A and G
  MISC_FEATURE (18)..(18): X is A and G
  MISC_FEATURE (19)..(19): X is 5-aminopentanoic acid for replacement of 3 or 4 amino acids of X2 and  X3
  MISC_FEATURE (20)..(20): X is D and E for acidic amino acids
  MISC_FEATURE (21)..(21): X is A and G
  MISC_FEATURE (22)..(22): X is N or Q for amidated amino acids
  MISC_FEATURE (23)..(23): X is D and E for acidic amino acids
  MISC_FEATURE (24)..(24): X is D and E for acidic amino acids
  MISC_FEATURE (25)..(25): X is K, R or H for basic amino acids
  MISC_FEATURE (26)..(26): X is A and G
  MISC_FEATURE (27)..(27): X is A and G
  MISC_FEATURE (28)..(28): X is I, L or V
  MISC_FEATURE (29)..(29): X is I, L or V
  MISC_FEATURE (30)..(30): X is C or S
  MISC_FEATURE (31)..(31): X is T or S
  MISC_FEATURE (32)..(32): X is A and G
  MISC_FEATURE (33)..(33): X is I, L or V
  MISC_FEATURE (34)..(34): X is I, L or V

SEQ ID NO: 845 - protein, 31 aa, artificial; identical to SEQ ID NO: 123
  Completely synthesized peptide construct
  MISC_FEATURE (1)..(1): X is T or S
  MISC_FEATURE (2)..(2): X is X1X1 or X1X3 or X3X1 or X1X2 or X2X1
  MISC_FEATURE (3)..(3): X is K, R or H for basic amino acids
  MISC_FEATURE (4)..(4): X is F or P
  MISC_FEATURE (5)..(5): X is Gaba for X2X3 or X3X2 or X2X3 or X3X2 or X3X3 or X2X2
  MISC_FEATURE (6)..(6): X is X1X1 or X1X3 or X3X1 or X1X2 or X2X1
  MISC_FEATURE (7)..(7): X is F, W or Y for aromatic amino acids
  MISC_FEATURE (8)..(8): X is K, R or H for basic amino acids
  MISC_FEATURE (9)..(9): X is X1X1 or X1X3 or X3X1 or X1X2 or X2X1
  MISC_FEATURE (10)..(10): X is N or Q for amidated amino acids
  MISC_FEATURE (11)..(11): X is A and G
  MISC_FEATURE (12)..(12): X is F or P
  MISC_FEATURE (13)..(13): X is K, R or H for basic amino acids
  MISC_FEATURE (14)..(14): X is X1X1 or X1X3 or X3X1 or X1X2 or X2X1
  MISC_FEATURE (15)..(15): X is F or P
  MISC_FEATURE (16)..(16): X is Acetyl or propionyl group, D glycine or D alanine, Cyclohexylalanine at amino terminus
  MISC_FEATURE (17)..(17): X is A and G
  MISC_FEATURE (18)..(18): X is A and G
  MISC_FEATURE (19)..(19): X is A and G
  MISC_FEATURE (20)..(20): X is D and E for acidic amino acids
  MISC_FEATURE (21)..(21): X is A and G
  MISC_FEATURE (22)..(22): X is N or Q for amidated amino acids
  MISC_FEATURE (23)..(23): X is Gaba for X2X3 or X3X2 or X2X3 or X3X2 or X3X3 or X2X2
  MISC_FEATURE (24)..(24): X is K, R or H for basic amino acids
  MISC_FEATURE (25)..(25): X is A and G
  MISC_FEATURE (26)..(26): X is A and G
  MISC_FEATURE (27)..(27): X is Gaba for X2X3 or X3X2 or X2X3 or X3X2 or X3X3 or X2X2
  MISC_FEATURE (28)..(28): X is C or S
  MISC_FEATURE (29)..(29): X is T or S
  MISC_FEATURE (30)..(30): X is A and G
  MISC_FEATURE (31)..(31): X is Gaba for X2X3 or X3X2 or X2X3 or X3X2 or X3X3 or X2X2

SEQ ID NO: 846 - protein, 36 aa, artificial
  Completely synthesized peptide construct
TGGKPGIAGFKGEQGPKGEPGGGDLLKNGERIEKVE

SEQ ID NO: 847 - protein, 36 aa, artificial; identical to SEQ ID NO: 164
  Completely synthesized peptide construct
  MISC_FEATURE (1)..(1): X is T or S
  MISC_FEATURE (2)..(2): X is A and G
  MISC_FEATURE (3)..(3): X is A and G
  MISC_FEATURE (4)..(4): X is K, R or H for basic amino acids
  MISC_FEATURE (5)..(5): X is F or P
  MISC_FEATURE (6)..(6): X is A and G
  MISC_FEATURE (7)..(7): X is I, L or V
  MISC_FEATURE (8)..(8): X is A and G
  MISC_FEATURE (9)..(9): X is A and G
  MISC_FEATURE (10)..(10): X is F, W or Y for aromatic amino acids
  MISC_FEATURE (11)..(11): X is K, R or H for basic amino acids
  MISC_FEATURE (12)..(12): X is A and G
  MISC_FEATURE (13)..(13): X is D and E for acidic amino acids
  MISC_FEATURE (14)..(14): X is N or Q for amidated amino acids
  MISC_FEATURE (15)..(15): X is A and G
  MISC_FEATURE (16)..(16): X is F or P
  MISC_FEATURE (17)..(17): X is K, R or H for basic amino acids
  MISC_FEATURE (18)..(18): X is A and G
  MISC_FEATURE (19)..(19): X is D and E for acidic amino acids
  MISC_FEATURE (20)..(20): X is F or P
  MISC_FEATURE (21)..(21): X is A and G
  MISC_FEATURE (22)..(22): X is A and G
  MISC_FEATURE (23)..(23): X is A and G
  MISC_FEATURE (24)..(24): X is D and E for acidic amino acids
  MISC_FEATURE (25)..(25): X is I, L or V
  MISC_FEATURE (26)..(26): X is I, L or V
  MISC_FEATURE (27)..(27): X is K, R or H for basic amino acids
  MISC_FEATURE (28)..(28): X is N or Q for amidated amino acids
  MISC_FEATURE (29)..(29): X is A and G
  MISC_FEATURE (30)..(30): X is D and E for acidic amino acids
  MISC_FEATURE (31)..(31): X is K, R or H for basic amino acids
  MISC_FEATURE (32)..(32): X is I, L or V
  MISC_FEATURE (33)..(33): X is D and E for acidic amino acids
  MISC_FEATURE (34)..(34): X is K, R or H for basic amino acids
  MISC_FEATURE (35)..(35): X is I, L or V
  MISC_FEATURE (36)..(36): X is D and E for acidic amino acids

SEQ ID NO: 848 - protein, 37 aa, artificial; identical to SEQ ID NO: 151
  Completely synthesized peptide construct
  MISC_FEATURE (1)..(1): X is T or S
  MISC_FEATURE (2)..(2): X is A and G
  MISC_FEATURE (3)..(3): X is A and G
  MISC_FEATURE (4)..(4): X is K, R or H for basic amino acids
  MISC_FEATURE (5)..(5): X is F or P
  MISC_FEATURE (6)..(6): X is A and G
  MISC_FEATURE (7)..(7): X is I, L or V
  MISC_FEATURE (8)..(8): X is A and G
  MISC_FEATURE (9)..(9): X is A and G
  MISC_FEATURE (10)..(10): X is F, W or Y for aromatic amino acids
  MISC_FEATURE (11)..(11): X is K, R or H for basic amino acids
  MISC_FEATURE (12)..(12): X is A and G
  MISC_FEATURE (13)..(13): X is D and E for acidic amino acids
  MISC_FEATURE (14)..(14): X is N or Q for amidated amino acids
  MISC_FEATURE (15)..(15): X is A and G
  MISC_FEATURE (16)..(16): X is F or P
  MISC_FEATURE (17)..(17): X is K, R or H for basic amino acids
  MISC_FEATURE (18)..(18): X is A and G
  MISC_FEATURE (19)..(19): X is D and E for acidic amino acids
  MISC_FEATURE (20)..(20): X is F or P
  MISC_FEATURE (21)..(21): X is A and G
  MISC_FEATURE (22)..(22): X is A and G
  MISC_FEATURE (23)..(23): X is A and G
  MISC_FEATURE (24)..(24): X is Acetyl or propionyl group, D glycine or D alanine, Cyclohexylalanine at amino terminus
  MISC_FEATURE (25)..(25): X is D and E for acidic amino acids
  MISC_FEATURE (26)..(26): X is I, L or V
  MISC_FEATURE (27)..(27): X is I, L or V
  MISC_FEATURE (28)..(28): X is K, R or H for basic amino acids
  MISC_FEATURE (29)..(29): X is N or Q for amidated amino acids
  MISC_FEATURE (30)..(30): X is A and G
  MISC_FEATURE (31)..(31): X is D and E for acidic amino acids
  MISC_FEATURE (32)..(32): X is K, R or H for basic amino acids
  MISC_FEATURE (33)..(33): X is I, L or V
  MISC_FEATURE (34)..(34): X is D and E for acidic amino acids
  MISC_FEATURE (35)..(35): X is K, R or H for basic amino acids
  MISC_FEATURE (36)..(36): X is I, L or V
  MISC_FEATURE (37)..(37): X is D and E for acidic amino acids

SEQ ID NO: 849 - protein, 33 aa, artificial; identical to SEQ ID NO: 97
  Completely synthesized peptide construct
  MISC_FEATURE (1)..(1): X is T or S
  MISC_FEATURE (2)..(2): X is A and G
  MISC_FEATURE (3)..(3): X is A and G
  MISC_FEATURE (4)..(4): X is K, R or H for basic amino acids
  MISC_FEATURE (5)..(5): X is F or P
  MISC_FEATURE (6)..(6): X is A and G
  MISC_FEATURE (7)..(7): X is I, L or V
  MISC_FEATURE (8)..(8): X is A and G
  MISC_FEATURE (9)..(9): X is A and G
  MISC_FEATURE (10)..(10): X is F, W or Y for aromatic amino acids
  MISC_FEATURE (11)..(11): X is K, R or H for basic amino acids
  MISC_FEATURE (12)..(12): X is A and G
  MISC_FEATURE (13)..(13): X is D and E for acidic amino acids
  MISC_FEATURE (14)..(14): X is N or Q for amidated amino acids
  MISC_FEATURE (15)..(15): X is A and G
  MISC_FEATURE (16)..(16): X is F or P
  MISC_FEATURE (17)..(17): X is K, R or H for basic amino acids
  MISC_FEATURE (18)..(18): X is A and G
  MISC_FEATURE (19)..(19): X is D and E for acidic amino acids
  MISC_FEATURE (20)..(20): X is F or P
  MISC_FEATURE (21)..(21): X is A and G
  MISC_FEATURE (22)..(22): X is A and G
  MISC_FEATURE (23)..(23): X is A and G
  MISC_FEATURE (24)..(24): X is Acetyl or propionyl group, D glycine or D alanine, Cyclohexylalanine at amino terminus
  MISC_FEATURE (25)..(25): X is Gaba for X2X3 or X3X2 or X2X3 or X3X2 or X3X3 or X2X2
  MISC_FEATURE (26)..(26): X is K, R or H for basic amino acids
  MISC_FEATURE (27)..(27): X is N or Q for amidated amino acids
  MISC_FEATURE (28)..(28): X is A and G
  MISC_FEATURE (29)..(29): X is D and E for acidic amino acids
  MISC_FEATURE (30)..(30): X is K, R or H for basic amino acids
  MISC_FEATURE (31)..(31): X is Gaba for X2X3 or X3X2 or X2X3 or X3X2 or X3X3 or X2X2
  MISC_FEATURE (32)..(32): X is K, R or H for basic amino acids
  MISC_FEATURE (33)..(33): X is Gaba for X2X3 or X3X2 or X2X3 or X3X2 or X3X3 or X2X2

SEQ ID NO: 850 - protein, 33 aa, artificial; identical to SEQ ID NO: 97
  Completely synthesized peptide construct
  MISC_FEATURE (1)..(1): X is T or S
  MISC_FEATURE (2)..(2): X is A and G
  MISC_FEATURE (3)..(3): X is A and G
  MISC_FEATURE (4)..(4): X is K, R or H for basic amino acids
  MISC_FEATURE (5)..(5): X is F or P
  MISC_FEATURE (6)..(6): X is A and G
  MISC_FEATURE (7)..(7): X is I, L or V
  MISC_FEATURE (8)..(8): X is A and G
  MISC_FEATURE (9)..(9): X is A and G
  MISC_FEATURE (10)..(10): X is F, W or Y for aromatic amino acids
  MISC_FEATURE (11)..(11): X is K, R or H for basic amino acids
  MISC_FEATURE (12)..(12): X is A and G
  MISC_FEATURE (13)..(13): X is D and E for acidic amino acids
  MISC_FEATURE (14)..(14): X is N or Q for amidated amino acids
  MISC_FEATURE (15)..(15): X is A and G
  MISC_FEATURE (16)..(16): X is F or P
  MISC_FEATURE (17)..(17): X is K, R or H for basic amino acids
  MISC_FEATURE (18)..(18): X is A and G
  MISC_FEATURE (19)..(19): X is D and E for acidic amino acids
  MISC_FEATURE (20)..(20): X is F or P
  MISC_FEATURE (21)..(21): X is A and G
  MISC_FEATURE (22)..(22): X is A and G
  MISC_FEATURE (23)..(23): X is A and G
  MISC_FEATURE (24)..(24): X is Acetyl or propionyl group, D glycine or D alanine, Cyclohexylalanine at amino terminus
  MISC_FEATURE (25)..(25): X is 5-aminopentanoic acid for replacement of 3 or 4 amino acids of X2 and  X3
  MISC_FEATURE (26)..(26): X is K, R or H for basic amino acids
  MISC_FEATURE (27)..(27): X is N or Q for amidated amino acids
  MISC_FEATURE (28)..(28): X is A and G
  MISC_FEATURE (29)..(29): X is D and E for acidic amino acids
  MISC_FEATURE (30)..(30): X is K, R or H for basic amino acids
  MISC_FEATURE (31)..(31): X is Gaba for X2X3 or X3X2 or X2X3 or X3X2 or X3X3 or X2X2
  MISC_FEATURE (32)..(32): X is K, R or H for basic amino acids
  MISC_FEATURE (33)..(33): X is Gaba for X2X3 or X3X2 or X2X3 or X3X2 or X3X3 or X2X2

SEQ ID NO: 851 - protein, 33 aa, artificial; identical to SEQ ID NO: 97
  Completely synthesized peptide construct
  MISC_FEATURE (1)..(1): X is T or S
  MISC_FEATURE (2)..(2): X is X1X1 or X1X3 or X3X1 or X1X2 or X2X1
  MISC_FEATURE (3)..(3): X is K, R or H for basic amino acids
  MISC_FEATURE (4)..(4): X is F or P
  MISC_FEATURE (5)..(5): X is Gaba for X2X3 or X3X2 or X2X3 or X3X2 or X3X3 or X2X2
  MISC_FEATURE (6)..(6): X is X1X1 or X1X3 or X3X1 or X1X2 or X2X1
  MISC_FEATURE (7)..(7): X is F, W or Y for aromatic amino acids
  MISC_FEATURE (8)..(8): X is K, R or H for basic amino acids
  MISC_FEATURE (9)..(9): X is X1X1 or X1X3 or X3X1 or X1X2 or X2X1
  MISC_FEATURE (10)..(10): X is N or Q for amidated amino acids
  MISC_FEATURE (11)..(11): X is A and G
  MISC_FEATURE (12)..(12): X is F or P
  MISC_FEATURE (13)..(13): X is K, R or H for basic amino acids
  MISC_FEATURE (14)..(14): X is X1X1 or X1X3 or X3X1 or X1X2 or X2X1
  MISC_FEATURE (15)..(15): X is F or P
  MISC_FEATURE (16)..(16): X is A and G
  MISC_FEATURE (17)..(17): X is A and G
  MISC_FEATURE (18)..(18): X is A and G
  MISC_FEATURE (19)..(19): X is D and E for acidic amino acids
  MISC_FEATURE (20)..(20): X is A and G
  MISC_FEATURE (21)..(21): X is N or Q for amidated amino acids
  MISC_FEATURE (22)..(22): X is D and E for acidic amino acids
  MISC_FEATURE (23)..(23): X is D and E for acidic amino acids
  MISC_FEATURE (24)..(24): X is K, R or H for basic amino acids
  MISC_FEATURE (25)..(25): X is A and G
  MISC_FEATURE (26)..(26): X is A and G
  MISC_FEATURE (27)..(27): X is I, L or V
  MISC_FEATURE (28)..(28): X is I, L or V
  MISC_FEATURE (29)..(29): X is C or S
  MISC_FEATURE (30)..(30): X is T or S
  MISC_FEATURE (31)..(31): X is A and G
  MISC_FEATURE (32)..(32): X is I, L or V
  MISC_FEATURE (33)..(33): X is I, L or V

SEQ ID NO: 852 - protein, 34 aa, artificial; identical to SEQ ID NO: 77
  Completely synthesized peptide construct
  MISC_FEATURE (1)..(1): X isT or S
  MISC_FEATURE (2)..(2): X is X1X1 or X1X3 or X3X1 or X1X2 or X2X1
  MISC_FEATURE (3)..(3): X is K, R or H for basic amino acids
  MISC_FEATURE (4)..(4): X is F or P
  MISC_FEATURE (5)..(5): X is Gaba for X2X3 or X3X2 or X2X3 or X3X2 or X3X3 or X2X2
  MISC_FEATURE (6)..(6): X is X1X1 or X1X3 or X3X1 or X1X2 or X2X1
  MISC_FEATURE (7)..(7): X is F, W or Y for aromatic amino acids
  MISC_FEATURE (8)..(8): X is K, R or H for basic amino acids
  MISC_FEATURE (9)..(9): X is X1X1 or X1X3 or X3X1 or X1X2 or X2X1
  MISC_FEATURE (10)..(10): X is N or Q for amidated amino acids
  MISC_FEATURE (11)..(11): X is A and G
  MISC_FEATURE (12)..(12): X is F or P
  MISC_FEATURE (13)..(13): X is K, R or H for basic amino acids
  MISC_FEATURE (14)..(14): X is X1X1 or X1X3 or X3X1 or X1X2 or X2X1
  MISC_FEATURE (15)..(15): X is F or P
  MISC_FEATURE (16)..(16): X is A and G
  MISC_FEATURE (17)..(17): X is A and G
  MISC_FEATURE (18)..(18): X is A and G
  MISC_FEATURE (19)..(19): X is Acetyl or propionyl group, D glycine or D alanine, Cyclohexylalanine at amino terminus
  MISC_FEATURE (20)..(20): X is D and E for acidic amino acids
  MISC_FEATURE (21)..(21): X is A and G
  MISC_FEATURE (22)..(22): X is N or Q for amidated amino acids
  MISC_FEATURE (23)..(23): X is D and E for acidic amino acids
  MISC_FEATURE (24)..(24): X is D and E for acidic amino acids
  MISC_FEATURE (25)..(25): X is K, R or H for basic amino acids
  MISC_FEATURE (26)..(26): X is A and G
  MISC_FEATURE (27)..(27): X is A and G
  MISC_FEATURE (28)..(28): X is I, L or V
  MISC_FEATURE (29)..(29): X is I, L or V
  MISC_FEATURE (30)..(30): X is C or S
  MISC_FEATURE (31)..(31): X is T or S
  MISC_FEATURE (32)..(32): X is A and G
  MISC_FEATURE (33)..(33): X is I, L or V
  MISC_FEATURE (34)..(34): X is I, L or V

SEQ ID NO: 853 - protein, 34 aa, artificial; identical to SEQ ID NO: 77
  Completely synthesized peptide construct
  MISC_FEATURE (1)..(1): X is T or S
  MISC_FEATURE (2)..(2): X is X1X1 or X1X3 or X3X1 or X1X2 or X2X1
  MISC_FEATURE (3)..(3): X is K, R or H for basic amino acids
  MISC_FEATURE (4)..(4): X is F or P
  MISC_FEATURE (5)..(5): X is Gaba for X2X3 or X3X2 or X2X3 or X3X2 or X3X3 or X2X2
  MISC_FEATURE (6)..(6): X is X1X1 or X1X3 or X3X1 or X1X2 or X2X1
  MISC_FEATURE (7)..(7): X is F, W or Y for aromatic amino acids
  MISC_FEATURE (8)..(8): X is K, R or H for basic amino acids
  MISC_FEATURE (9)..(9): X is X1X1 or X1X3 or X3X1 or X1X2 or X2X1
  MISC_FEATURE (10)..(10): X is N or Q for amidated amino acids
  MISC_FEATURE (11)..(11): X is A and G
  MISC_FEATURE (12)..(12): X is F or P
  MISC_FEATURE (13)..(13): X is K, R or H for basic amino acids
  MISC_FEATURE (14)..(14): X is X1X1 or X1X3 or X3X1 or X1X2 or X2X1
  MISC_FEATURE (15)..(15): X is F or P
  MISC_FEATURE (16)..(16): X is A and G
  MISC_FEATURE (17)..(17): X is A and G
  MISC_FEATURE (18)..(18): X is A and G
  MISC_FEATURE (19)..(19): X is 5-aminopentanoic acid for replacement of 3 or 4 amino acids of X2 and  X3
  MISC_FEATURE (20)..(20): X is D and E for acidic amino acids
  MISC_FEATURE (21)..(21): X is A and G
  MISC_FEATURE (22)..(22): X is N or Q for amidated amino acids
  MISC_FEATURE (23)..(23): X is D and E for acidic amino acids
  MISC_FEATURE (24)..(24): X is D and E for acidic amino acids
  MISC_FEATURE (25)..(25): X is K, R or H for basic amino acids
  MISC_FEATURE (26)..(26): X is A and G
  MISC_FEATURE (27)..(27): X is A and G
  MISC_FEATURE (28)..(28): X is I, L or V
  MISC_FEATURE (29)..(29): X is I, L or V
  MISC_FEATURE (30)..(30): X is C or S
  MISC_FEATURE (31)..(31): X is T or S
  MISC_FEATURE (32)..(32): X is A an G
  MISC_FEATURE (33)..(33): X is I, L or V
  MISC_FEATURE (34)..(34): X is I, L or V

SEQ ID NO: 854 - protein, 31 aa, artificial; identical to SEQ ID NO: 123
  Completely synthesized peptide construct
  MISC_FEATURE (1)..(1): X is T or S
  MISC_FEATURE (2)..(2): X is X1X1 or X1X3 or X3X1 or X1X2 or X2X1
  MISC_FEATURE (3)..(3): X is K, R or H for basic amino acids
  MISC_FEATURE (4)..(4): X is F or P
  MISC_FEATURE (5)..(5): X is Gaba for X2X3 or X3X2 or X2X3 or X3X2 or X3X3 or X2X2
  MISC_FEATURE (6)..(6): X is X1X1 or X1X3 or X3X1 or X1X2 or X2X1
  MISC_FEATURE (7)..(7): X is F, W or Y for aromatic amino acids
  MISC_FEATURE (8)..(8): X is K, R or H for basic amino acids
  MISC_FEATURE (9)..(9): X is X1X1 or X1X3 or X3X1 or X1X2 or X2X1
  MISC_FEATURE (10)..(10): X is N or Q for amidated amino acids
  MISC_FEATURE (11)..(11): X is A and G
  MISC_FEATURE (12)..(12): X is F or P
  MISC_FEATURE (13)..(13): X is K, R or H for basic amino acids
  MISC_FEATURE (14)..(14): X is X1X1 or X1X3 or X3X1 or X1X2 or X2X1
  MISC_FEATURE (15)..(15): X is F or P
  MISC_FEATURE (16)..(16): X is Acetyl or propionyl group, D glycine or D alanine, Cyclohexylalanine at amino terminus
  MISC_FEATURE (17)..(17): X is A and G
  MISC_FEATURE (18)..(18): X is A and G
  MISC_FEATURE (19)..(19): X is A and G
  MISC_FEATURE (20)..(20): X is D and E for acidic amino acids
  MISC_FEATURE (21)..(21): X is A and G
  MISC_FEATURE (22)..(22): X is N or Q for amidated amino acids
  MISC_FEATURE (23)..(23): X is Gaba for X2X3 or X3X2 or X2X3 or X3X2 or X3X3 or X2X2
  MISC_FEATURE (24)..(24): X is K, R or H for basic amino acids
  MISC_FEATURE (25)..(25): X is A and G
  MISC_FEATURE (26)..(26): X is A and G
  MISC_FEATURE (27)..(27): X is Gaba for X2X3 or X3X2 or X2X3 or X3X2 or X3X3 or X2X2
  MISC_FEATURE (28)..(28): X is C or S
  MISC_FEATURE (29)..(29): X is T or S
  MISC_FEATURE (30)..(30): X is A and G
  MISC_FEATURE (31)..(31): X is Gaba for X2X3 or X3X2 or X2X3 or X3X2 or X3X3 or X2X2

SEQ ID NO: 855 - protein, 20 aa, Mus musculus
DAGEPGIAGFKGDQGPKGET

SEQ ID NO: 856 - protein, 46 aa, Artificial Sequence
  Heteroconjugate construct
DLLKNGERIEKVEGGGDAEFRHDSGYEVHHQKLVFFAENVGSNKAI

SEQ ID NO: 857 - protein, 41 aa, Artificial Sequence
  Heteroconjugate construct
DLLKNGERIEKVEGGGKRKLEGDLKLTQESIMDLENDKQQL

SEQ ID NO: 858 - protein, 37 aa, Artificial Sequence
  Heteroconjugate construct
DLLKNGERIEKVEGGGAKVTKNITEIADLTQKIFDLR

SEQ ID NO: 859 - protein, 35 aa, Artificial Sequence
  Heteroconjugate construct
DLLKNGERIEKVEGGGVRRLAMENNIKLSEVVGSG

SEQ ID NO: 860 - protein, 34 aa, Artificial Sequence
  Heteroconjugate construct
DLLKNGERIEKVEGGGKEALISSLTRGKLTYTQQ

SEQ ID NO: 861 - protein, 34 aa, Artificial Sequence
  Heteroconjugate construct
DLLKNGERIEKVEGGGSERVQLLHSQNTSLINQK

SEQ ID NO: 862 - protein, 35 aa, Artificial Sequence
  Heteroconjugate construct
DLLKNGERIEKVEGGGYSDVWSFGVVLWEIATLAE

SEQ ID NO: 863 - protein, 31 aa, Artificial Sequence
  Heteroconjugate construct
DLLKNGERIEKVEGGGSHLVEALYLVCGERG

SEQ ID NO: 864 - protein, 40 aa, Artificial Sequence
  Heteroconjugate construct
DLLKNGERIEKVEGGGVLGGGCALLRCIPALDSLTPANED

SEQ ID NO: 865 - protein, 35 aa, Artificial Sequence
  Heteroconjugate construct
DLLKNGERIEKVEGGGIPPSLRYLEDEERMSRLSK

SEQ ID NO: 866 - protein, 36 aa, Artificial Sequence
  Heteroconjugate construct
DLLKNGERIEKVEGGGNTNMFTYEIAPVFVLLEYVT

SEQ ID NO: 867 - protein, 36 aa, Artificial Sequence
  Heteroconjugate construct
DLLKNGERIEKVEGGGVVKSFDRSTKVIDFHYPNEL

SEQ ID NO: 868 - protein, 37 aa, Artificial Sequence
  Heteroconjugate construct
DLLKNGERIEKVEGGGVSSVSSQFSDAAQASPSSHSS

SEQ ID NO: 869 - protein, 37 aa, Artificial Sequence
  Heteroconjugate construct
DLLKNGERIEKVEGGGMVWESGCTVIVMLTPLVEDGV

SEQ ID NO: 870 - protein, 35 aa, Artificial Sequence
  Heteroconjugate construct
DLLKNGERIEKVEGGGFYLKNVQTQETRTLTQFHF

SEQ ID NO: 871 - protein, 36 aa, Artificial Sequence
  Heteroconjugate construct
DLLKNGERIEKVEGGGDGEAGKPGKAGERGPPGPQG

SEQ ID NO: 872 - protein, 36 aa, Artificial Sequence
  Heteroconjugate construct
DLLKNGERIEKVEGGGGLDGAKGEAGAPGVKGESGS

SEQ ID NO: 873 - protein, 36 aa, Artificial Sequence
  Heteroconjugate construct
DLLKNGERIEKVEGGGERGAAGIAGDKGDRGDVGEK

SEQ ID NO: 874 - protein, 33 aa, Artificial Sequence
  Heteroconjugate construct
DLLKNGERIEKVEGGGDGRGDSLAYGLRSKSKK

SEQ ID NO: 875 - protein, 31 aa, Artificial Sequence
  Heteroconjugate construct
DLLKNGERIEKVEGGGQKRAAYKQYGHAAFE

SEQ ID NO: 876 - protein, 30 aa, Artificial Sequence
  Heteroconjugate construct
DLLKNGERIEKVEGGGERAAYDQYGHAAFE

SEQ ID NO: 877 - protein, 35 aa, Artificial Sequence
  Heteroconjugate construct
DLLKNGERIEKVEGGGCRVLGGGGTGGGGGLGGPG

SEQ ID NO: 878 - protein, 35 aa, Artificial Sequence
  Heteroconjugate construct
DLLKNGERIEKVEGGGCLGLLAVAAVAAAGANPAQ

SEQ ID NO: 879 - protein, 32 aa, Artificial Sequence
  Heteroconjugate construct
DLLKNGERIEKVEGGGNVREGIAFRPASKFTV

SEQ ID NO: 880 - protein, 30 aa, Artificial Sequence
  Heteroconjugate construct
  misc_feature (18)..(18): Xaa can be any naturally occurring amino acid
  misc_feature (25)..(25): Xaa can be any naturally occurring amino acid
DLLKNGERIEKVEGGGEXIKFAAAXREGED

SEQ ID NO: 881 - protein, 34 aa, Artificial Sequence
  Heteroconjugate construct
DLLKNGERIEKVEGGGVVHFFKNIVTPRTPPPSQ

SEQ ID NO: 882 - protein, 30 aa, Artificial Sequence
  Heteroconjugate construct
DLLKNGERIEKVEGGGVVHFFKNIVTPRTP

SEQ ID NO: 883 - protein, 39 aa, Artificial Sequence
  Heteroconjugate construct
DLLKNGERIEKVEGGGLERVCHSLGKWLGHPDKFVGITY

SEQ ID NO: 884 - protein, 37 aa, Artificial Sequence
  Heteroconjugate construct
DLLKNGERIEKVEGGGSTFKNTEISFKLGQEFEETTA

SEQ ID NO: 885 - protein, 27 aa, Artificial Sequence
  Heteroconjugate construct
DLLKNGERIEKVEGGGSLDGELKALFK

SEQ ID NO: 886 - protein, 34 aa, Artificial Sequence
  Heteroconjugate construct
DLLKNGERIEKVEGGGIYFNTWTTCQSIAFPSKT

SEQ ID NO: 887 - protein, 39 aa, Artificial Sequence
  Heteroconjugate construct
DLLKNGERIEKVEGGGQKFSEHFSIHCCPPFTFLNSSKR

SEQ ID NO: 888 - protein, 36 aa, Artificial Sequence
  Heteroconjugate construct
DLLKNGERIEKVEGGGGQFRVIGPRHPIRALVGDEV

SEQ ID NO: 889 - protein, 36 aa, Artificial Sequence
  Heteroconjugate construct
DLLKNGERIEKVEGGGNATGMEVGWYRPPFSRVVHL

SEQ ID NO: 890 - protein, 36 aa, Artificial Sequence
  Heteroconjugate construct
DLLKNGERIEKVEGGGSDEGGFTCFFRDHSYQEEAA

SEQ ID NO: 891 - protein, 36 aa, Artificial Sequence
  Heteroconjugate construct
DLLKNGERIEKVEGGGQAPEYRGRTELLKDAIGEGK

SEQ ID NO: 892 - protein, 31 aa, Artificial Sequence
  Heteroconjugate construct
DLLKNGERIEKVEGGGENPVVHFFKNIVTPR

SEQ ID NO: 893 - protein, 32 aa, Artificial Sequence
  Heteroconjugate construct
DLLKNGERIEKVEGGGQSIAFPSKTSASIGSL

SEQ ID NO: 894 - protein, 36 aa, Artificial Sequence
  Heteroconjugate construct
DLLKNGERIEKVEGGGSKTSASIGSLCADARMYGVL

SEQ ID NO: 895 - protein, 35 aa, Artificial Sequence
  Heteroconjugate construct
DLLKNGERIEKVEGGGGGFTCFFRDHSYQEEAAME

SEQ ID NO: 896 - protein, 38 aa, Artificial Sequence
  Heteroconjugate construct
DLLKNGERIEKVEGGGGRTQDVVHFFKNIVTPRTPPPS

SEQ ID NO: 897 - protein, 36 aa, Artificial Sequence
  Heteroconjugate construct
DLLKNGERIEKVEGGGTGTEKLIETYFSKNYQDYEY

SEQ ID NO: 898 - protein, 29 aa, Artificial Sequence
  Heteroconjugate construct
DLLKNGERIEKVEGGGHSLGKWLGHPDKF

SEQ ID NO: 899 - protein, 32 aa, Artificial Sequence
  Heteroconjugate construct
DLLKNGERIEKVEGGGVGWYRPPFSRVVHLYR

SEQ ID NO: 900 - protein, 32 aa, Artificial Sequence
  Heteroconjugate construct
DLLKNGERIEKVEGGGVFLCLQYRLRGKLRAE

SEQ ID NO: 901 - protein, 30 aa, Artificial Sequence
  Heteroconjugate construct
DLLKNGERIEKVEGGGDGSSWEGVGVVPDV

SEQ ID NO: 902 - protein, 41 aa, Artificial Sequence
  Heteroconjugate construct
DLLKNGERIEKVEGGGNGMLHGDKVSFFCKNKEKKCSYTED

SEQ ID NO: 903 - protein, 39 aa, Artificial Sequence
  Heteroconjugate construct
DLLKNGERIEKVEGGGTVFLLVIVELIPSTSSAVPLIGK

SEQ ID NO: 904 - protein, 34 aa, Artificial Sequence
  Heteroconjugate construct
DLLKNGERIEKVEGGGDTPYLDITYHFVMQRLPL

SEQ ID NO: 905 - protein, 29 aa, Artificial Sequence
  Heteroconjugate construct
DLLKNGERIEKVEGGGVIVELIPSTSSAV

SEQ ID NO: 906 - protein, 35 aa, Artificial Sequence
  Heteroconjugate construct
DLLKNGERIEKVEGGGNYLADEEEEAEEEARVTVV

SEQ ID NO: 907 - protein, 35 aa, Artificial Sequence
  Heteroconjugate construct
DLLKNGERIEKVEGGGILQVTSLLILLLLLIKAAQ

SEQ ID NO: 908 - protein, 35 aa, Artificial Sequence
  Heteroconjugate construct
DLLKNGERIEKVEGGGECPLDPGGYFIVKGVEKVI

SEQ ID NO: 909 - protein, 35 aa, Artificial Sequence
  Heteroconjugate construct
DLLKNGERIEKVEGGGGGLRLGEMERDCLIGYGAS

SEQ ID NO: 910 - protein, 34 aa, Artificial Sequence
  Heteroconjugate construct
DLLKNGERIEKVEGGGMSETAPAAPAAPAPAEKT

SEQ ID NO: 911 - protein, 35 aa, Artificial Sequence
  Heteroconjugate construct
DLLKNGERIEKVEGGGGGGFRGGRGGGGGGFRGGR

SEQ ID NO: 912 - protein, 35 aa, Artificial Sequence
  Heteroconjugate construct
DLLKNGERIEKVEGGGIPKNLLDSKSLKLIISMTL

SEQ ID NO: 913 - protein, 35 aa, Artificial Sequence
  Heteroconjugate construct
DLLKNGERIEKVEGGGQHLHNNRIIHRDVKGNNIL

SEQ ID NO: 914 - protein, 35 aa, Artificial Sequence
  Heteroconjugate construct
DLLKNGERIEKVEGGGRSRSFSKSRSRSRSLSRSR

SEQ ID NO: 915 - protein, 35 aa, Artificial Sequence
  Heteroconjugate construct
DLLKNGERIEKVEGGGGTRLHGGKDAASPRYIFTM

SEQ ID NO: 916 - protein, 35 aa, Artificial Sequence
  Heteroconjugate construct
DLLKNGERIEKVEGGGAPGFPGAVGPAGPPGLQGP

SEQ ID NO: 917 - protein, 21 aa, Homo sapiens
AKVTKNITEIADLTQKIFDLR

SEQ ID NO: 918 - protein, 20 aa, Homo sapiens
VVKSFDRSTKVIDFHYPNEL

SEQ ID NO: 919 - protein, 9 aa, Homo sapiens
GGGTGGGGG

SEQ ID NO: 920 - protein, 19 aa, Homo sapiens
CRVLGGGGTGGGGGLGGPG

SEQ ID NO: 921 - protein, 9 aa, Homo sapiens
AVAAVAAAG

SEQ ID NO: 922 - protein, 19 aa, Homo sapiens
CLGLLAVAAVAAAGANPAQ

SEQ ID NO: 923 - protein, 14 aa, Homo sapiens
VVHFFKNIVTPRTP

SEQ ID NO: 924 - protein, 23 aa, Homo sapiens
LERVCHSLGKWLGHPDKFVGITY

SEQ ID NO: 925 - protein, 21 aa, Homo sapiens
STFKNTEISFKLGQEFEETTA

SEQ ID NO: 926 - protein, 22 aa, Homo sapiens
GRTQDVVHFFKNIVTPRTPPPS

SEQ ID NO: 927 - protein, 25 aa, Homo sapiens
NGMLHGDKVSFFCKNKEKKCSYTED

SEQ ID NO: 928 - protein, 19 aa, Homo sapiens
NYLADEEEEAEEEARVTVV

SEQ ID NO: 929 - protein, 19 aa, Homo sapiens
ILQVTSLLILLLLLIKAAQ

SEQ ID NO: 930 - protein, 9 aa, Homo sapiens
PGGYFIVKG

SEQ ID NO: 931 - protein, 19 aa, Homo sapiens
ECPLDPGGYFIVKGVEKVI

SEQ ID NO: 932 - protein, 19 aa, Homo sapiens
GGLRLGEMERDCLIGYGAS

SEQ ID NO: 933 - protein, 9 aa, Homo sapiens
APAAPAAPA

SEQ ID NO: 934 - protein, 18 aa, Homo sapiens
MSETAPAAPAAPAPAEKT

SEQ ID NO: 935 - protein, 9 aa, Homo sapiens
GGRGGGGGG

SEQ ID NO: 936 - protein, 19 aa, Homo sapiens
GGGFRGGRGGGGGGFRGGR

SEQ ID NO: 937 - protein, 9 aa, Homo sapiens
LDSKSLKLI

SEQ ID NO: 938 - protein, 19 aa, Homo sapiens
IPKNLLDSKSLKLIISMTL

SEQ ID NO: 939 - protein, 9 aa, Homo sapiens
NRIIHRDVK

SEQ ID NO: 940 - protein, 19 aa, Homo sapiens
QHLHNNRIIHRDVKGNNIL

SEQ ID NO: 941 - protein, 9 aa, Homo sapiens
SKSRSRSRS

SEQ ID NO: 942 - protein, 19 aa, Homo sapiens
RSRSFSKSRSRSRSLSRSR

SEQ ID NO: 943 - protein, 9 aa, Homo sapiens
GGKDAASPR

SEQ ID NO: 944 - protein, 19 aa, Homo sapiens
GTRLHGGKDAASPRYIFTM

SEQ ID NO: 945 - protein, 9 aa, Homo sapiens
GAVGPAGPP

SEQ ID NO: 946 - protein, 19 aa, Homo sapiens
APGFPGAVGPAGPPGLQGP

SEQ ID NO: 947 - protein, 9 aa, Homo sapiens
EEEEAEEEA

SEQ ID NO: 948 - protein, 9 aa, Homo sapiens
SLLILLLLL

SEQ ID NO: 949 - protein, 9 aa, Homo sapiens
GEMERDCLI

SEQ ID NO: 950 - protein, 19 aa, Homo sapiens
GGFTCFFRDHSYQEEAAME

SEQ ID NO: 951 - protein, 23 aa, Homo sapiens
TVFLLVIVELIPSTSSAVPLIGK

SEQ ID NO: 952 - protein, 16 aa, herpes simplex virus 7
SLKMADPNRFRGKDLP

SEQ ID NO: 953 - protein, 32 aa, Artificial Sequence
  Heteroconjugate construct
DLLKNGERIEKVEGGGSLKMADPNRFRGKDLP

SEQ ID NO: 954 - protein, 30 aa, Human immunodeficiency virus
YSVHQRIDVKDTKEALEKIEEEQNKSKKKA

SEQ ID NO: 955 - protein, 46 aa, Artificial Sequence
  Heteroconjugate construct
DLLKNGERIEKVEGGGYSVHQRIDVKDTKEALEKIEEEQNKSKKKA

SEQ ID NO: 956 - protein, 36 aa, Artificial Sequence
  Heteroconjugate construct
DLLKNGERIEKVEGGGDAGEPGIAGFKGDQGPKGET

SEQ ID NO: 957 - protein, 9 aa, Homo sapiens
SFGVVLWEI

SEQ ID NO: 958 - protein, 19 aa, Homo sapiens
YSDVWSFGVVLWEIATLAE

SEQ ID NO: 959 - protein, 18 aa, Homo sapiens
VVHFFKNIVTPRTPPPSQ

SEQ ID NO: 960 - protein, 15 aa, Homo sapiens
DAEFRHDSGYEVHHQ

SEQ ID NO: 961 - protein, 18 aa, Homo sapiens
KLVFFAEDVGSNKGAIIG

SEQ ID NO: 962 - protein, 12 aa, Homo sapiens
GARGLTGRPGDA

SEQ ID NO: 963 - protein, 20 aa, Homo sapiens
PGLPGARGLTGRPGDAGPQG

SEQ ID NO: 964 - protein, 31 aa, Artificial Sequence
  Artificial construct containing amino acids 38-50 from the human beta-2-microglobulin chain
DLLKNGERIEKVEGGGDAEFRHDSGYEVHHQ

SEQ ID NO: 965 - protein, 34 aa, Artificial Sequence
  Artificial construct containing amino acids 38-50 from the human beta-2-microglobulin chain
DLLKNGERIEKVEGGGKLVFFAEDVGSNKGAIIG

SEQ ID NO: 966 - protein, 36 aa, Artificial Sequence
  Artificial construct containing amino acids 38-50 from the human beta-2-microglobulin chain
DLLKNGERIEKVEGGGPGLPGARGLTGRPGDAGPQG

SEQ ID NO: 967 - protein, 19 aa, Homo sapiens
ASSSILINESEPTTNIQIR

SEQ ID NO: 968 - protein, 17 aa, Homo sapiens
FAALDDEEEDKEEEIIK

SEQ ID NO: 969 - protein, 13 aa, Homo sapiens
QLVNMCMNPDPEK

SEQ ID NO: 970 - protein, 9 aa, Homo sapiens
YLSGANLNL

SEQ ID NO: 971 - protein, 15 aa, Homo sapiens
YACFVSNLATGRNNS

SEQ ID NO: 972 - protein, 9 aa, Homo sapiens
GVALQTMKQ

SEQ ID NO: 973 - protein, 9 aa, Homo sapiens
KIFGSLAFL

SEQ ID NO: 974 - protein, 9 aa, Homo sapiens
RLLQETELV

SEQ ID NO: 975 - protein, 9 aa, Homo sapiens
ALCRWGLLL

SEQ ID NO: 976 - protein, 9 aa, Homo sapiens
HLYQGCQVV

SEQ ID NO: 977 - protein, 10 aa, Homo sapiens
YLVPQQGFFC

SEQ ID NO: 978 - protein, 16 aa, Homo sapiens
VPIKWMALWSILRRRF

SEQ ID NO: 979 - protein, 9 aa, Homo sapiens
STAPPAHGV

SEQ ID NO: 980 - protein, 9 aa, Homo sapiens
LLNQLQVNL

SEQ ID NO: 981 - protein, 13 aa, Homo sapiens
DRAHYNIVTFCCK

SEQ ID NO: 982 - protein, 9 aa, Homo sapiens
STYKNENFK

SEQ ID NO: 983 - protein, 9 aa, Homo sapiens
SAPRTSTKK

SEQ ID NO: 984 - protein, 9 aa, Homo sapiens
TSESQLFNK

SEQ ID NO: 985 - protein, 9 aa, Homo sapiens
KTLEERVKK

SEQ ID NO: 986 - protein, 9 aa, Homo sapiens
RLQCVQCKK

SEQ ID NO: 987 - protein, 9 aa, Homo sapiens
ILIRCIICQ

SEQ ID NO: 988 - protein, 10 aa, Homo sapiens
YMLDLQPETT

SEQ ID NO: 989 - protein, 10 aa, Homo sapiens
LLAARAIVAI

SEQ ID NO: 990 - protein, 9 aa, Homo sapiens
ALCNTDSPL

SEQ ID NO: 991 - protein, 9 aa, Homo sapiens
ILLWQPIPV

SEQ ID NO: 992 - protein, 9 aa, Homo sapiens
KLQCVDLHV

SEQ ID NO: 993 - protein, 16 aa, Homo sapiens
FLRPGDDSSHDLNLLR

SEQ ID NO: 994 - protein, 16 aa, Homo sapiens
FQELESETLKSEEFQK

SEQ ID NO: 995 - protein, 21 aa, Homo sapiens
GLESNVNVELLNALHSHMNKR

SEQ ID NO: 996 - protein, 10 aa, Homo sapiens
REPVTKAEML

SEQ ID NO: 997 - protein, 9 aa, Homo sapiens
EVDPIGHLY

SEQ ID NO: 998 - protein, 9 aa, Homo sapiens
SVYDFFVWL

SEQ ID NO: 999 - protein, 9 aa, Homo sapiens
MSLQRQFLR

SEQ ID NO: 1000 - protein, 14 aa, Homo sapiens
AGDFLEANYMNLQR

SEQ ID NO: 1001 - protein, 20 aa, Homo sapiens
ILLQGTPVAQMTEDAVDAER

SEQ ID NO: 1002 - protein, 10 aa, Homo sapiens
KGYTQQLAFR

SEQ ID NO: 1003 - protein, 12 aa, Homo sapiens
QPSSAFAAFVKR

SEQ ID NO: 1004 - protein, 6 aa, Homo sapiens
WLNEQR

SEQ ID NO: 1005 - protein, 24 aa, Homo sapiens
FTPTETNKAEQCCEETASSISLHG

SEQ ID NO: 1006 - protein, 23 aa, Homo sapiens
QYTGTSYDPELTESSGSASHIDC

SEQ ID NO: 1007 - protein, 17 aa, Homo sapiens
FLKKHNLNPARKYFPQW

SEQ ID NO: 1008 - protein, 19 aa, Homo sapiens
FLKKHNLNPARKYFPQWEA

SEQ ID NO: 1009 - protein, 30 aa, Homo sapiens
ETKKTEDRFVPSSSKSEGKKSREQPSVLSR

SEQ ID NO: 1010 - protein, 24 aa, Homo sapiens
DAHKSEVAHRFKDLGEENFKALVL

SEQ ID NO: 1011 - protein, 36 aa, Homo sapiens
SIPPEVKFNKPFVFLMIEQNTKSPLFMGKVVNPTQK

SEQ ID NO: 1012 - protein, 17 aa, Homo sapiens
LSLLMWITQCFLPVFLA

SEQ ID NO: 1013 - protein, 19 aa, Artificial Sequence
  Heteroconjugate construct
PPDSSYLSGANLNLSCHSA

SEQ ID NO: 1014 - protein, 25 aa, Artificial Sequence
  Heteroconjugate construct
NNNGTYACFVSNLATGRNNSIVKSI

SEQ ID NO: 1015 - protein, 19 aa, Artificial Sequence
  Heteroconjugate construct
DLCQAGVALQTMKQEFLIN

SEQ ID NO: 1016 - protein, 19 aa, Artificial Sequence
  Heteroconjugate construct
FAGCKKIFGSLAFLPESFD

SEQ ID NO: 1017 - protein, 19 aa, Artificial Sequence
  Heteroconjugate construct
KYTMRRLLQETELVEPLTP

SEQ ID NO: 1018 - protein, 18 aa, Artificial Sequence
  Heteroconjugate construct
MELAALCRWGLLLALLPP

SEQ ID NO: 1019 - protein, 19 aa, Artificial Sequence
  Heteroconjugate construct
LDMLRHLYQGCQVVQGNLE

SEQ ID NO: 1020 - protein, 20 aa, Artificial Sequence
  Heteroconjugate construct
VDAEEYLVPQQGFFCPDPAP

SEQ ID NO: 1021 - protein, 26 aa, Artificial Sequence
  Heteroconjugate construct
ADGGKVPIKWMALWSILRRRFTHQSD

SEQ ID NO: 1022 - protein, 18 aa, Artificial Sequence
  Heteroconjugate construct
STAPPAHGVSTAPPAHGV

SEQ ID NO: 1023 - protein, 19 aa, Artificial Sequence
  Heteroconjugate construct
SDGSVLLNQLQVNLPHVTA

SEQ ID NO: 1024 - protein, 23 aa, Artificial Sequence
  Heteroconjugate construct
GQAEPDRAHYNIVTFCCKCDSTL

SEQ ID NO: 1025 - protein, 19 aa, Artificial Sequence
  Heteroconjugate construct
EVKKESTYKNENFKEYLRH

SEQ ID NO: 1026 - protein, 19 aa, Artificial Sequence
  Heteroconjugate construct
KRPASSAPRTSTKKKKVKR

SEQ ID NO: 1027 - protein, 19 aa, Artificial Sequence
  Heteroconjugate construct
SGSMVTSESQLFNKPYWLQ

SEQ ID NO: 1028 - protein, 19 aa, Artificial Sequence
  Heteroconjugate construct
YSLYGKTLEERVKKPLSEI

SEQ ID NO: 1029 - protein, 19 aa, Artificial Sequence
  Heteroconjugate construct
SVHEIRLQCVQCKKELQRR

SEQ ID NO: 1030 - protein, 19 aa, Artificial Sequence
  Heteroconjugate construct
KPLSEILIRCIICQTPLCP

SEQ ID NO: 1031 - protein, 20 aa, Artificial Sequence
  Heteroconjugate construct
PTLHEYMLDLQPETTDLYCY

SEQ ID NO: 1032 - protein, 20 aa, Artificial Sequence
  Heteroconjugate construct
TWEKLLLAARAIVAIENPAD

SEQ ID NO: 1033 - protein, 19 aa, Artificial Sequence
  Heteroconjugate construct
NLPTIALCNTDSPLRYVDI

SEQ ID NO: 1034 - protein, 19 aa, Artificial Sequence
  Heteroconjugate construct
SIWNPILLWQPIPVHTVPL

SEQ ID NO: 1035 - protein, 19 aa, Artificial Sequence
  Heteroconjugate construct
FLTPKKLQCVDLHVISNDV

SEQ ID NO: 1036 - protein, 24 aa, Artificial Sequence
  Heteroconjugate construct
LLKYRAREPVTKAEMLGSVVGNWQ

SEQ ID NO: 1037 - protein, 19 aa, Artificial Sequence
  Heteroconjugate construct
GIELMEADPIGHLYIFATC

SEQ ID NO: 1038 - protein, 19 aa, Artificial Sequence
  Heteroconjugate construct
FANCSSVYDFFVWLHYYSV

SEQ ID NO: 1039 - protein, 14 aa, Artificial Sequence
  Heteroconjugate construct
MSLQRQFLRTQLWD

SEQ ID NO: 1040 - protein, 24 aa, Artificial Sequence
  Heteroconjugate construct
GSITKAGDFLEANYMNLQRSYTVA

SEQ ID NO: 1041 - protein, 20 aa, Artificial Sequence
  Heteroconjugate construct
LELIKKGYTQQLAFRQPSSA

SEQ ID NO: 1042 - protein, 22 aa, Artificial Sequence
  Heteroconjugate construct
QLAFRQPSSAFAAFVKRAPSTW

SEQ ID NO: 1043 - protein, 16 aa, Artificial Sequence
  Heteroconjugate construct
PPVVRWLNEQRYYGGG

SEQ ID NO: 1044 - protein, 27 aa, Artificial Sequence
  Heteroconjugate construct
SCLQQLSLLMWITQCFLPVFLAQPPSG

SEQ ID NO: 1045 - protein, 35 aa, Artificial Sequence
  Heteroconjugate construct
DLLKNGERIEKVEGGGASSSILINESEPTTNIQIR

SEQ ID NO: 1046 - protein, 33 aa, Artificial Sequence
  Heteroconjugate construct
DLLKNGERIEKVEGGGFAALDDEEEDKEEEIIK

SEQ ID NO: 1047 - protein, 29 aa, Artificial Sequence
  Heteroconjugate construct
DLLKNGERIEKVEGGGQLVNMCMNPDPEK

SEQ ID NO: 1048 - protein, 35 aa, Artificial Sequence
  Heteroconjugate construct
DLLKNGERIEKVEGGGPPDSSYLSGANLNLSCHSA

SEQ ID NO: 1049 - protein, 41 aa, Artificial Sequence
  Heteroconjugate construct
DLLKNGERIEKVEGGGNNNGTYACFVSNLATGRNNSIVKSI

SEQ ID NO: 1050 - protein, 35 aa, Artificial Sequence
  Heteroconjugate construct
DLLKNGERIEKVEGGGDLCQAGVALQTMKQEFLIN

SEQ ID NO: 1051 - protein, 35 aa, Artificial Sequence
  Heteroconjugate construct
DLLKNGERIEKVEGGGFAGCKKIFGSLAFLPESFD

SEQ ID NO: 1052 - protein, 35 aa, Artificial Sequence
  Heteroconjugate construct
DLLKNGERIEKVEGGGKYTMRRLLQETELVEPLTP

SEQ ID NO: 1053 - protein, 34 aa, Artificial Sequence
  Heteroconjugate construct
DLLKNGERIEKVEGGGMELAALCRWGLLLALLPP

SEQ ID NO: 1054 - protein, 35 aa, Artificial Sequence
  Heteroconjugate construct
DLLKNGERIEKVEGGGLDMLRHLYQGCQVVQGNLE

SEQ ID NO: 1055 - protein, 36 aa, Artificial Sequence
  Heteroconjugate construct
DLLKNGERIEKVEGGGVDAEEYLVPQQGFFCPDPAP

SEQ ID NO: 1056 - protein, 42 aa, Artificial Sequence
  Heteroconjugate construct
DLLKNGERIEKVEGGGADGGKVPIKWMALWSILRRRFTHQSD

SEQ ID NO: 1057 - protein, 34 aa, Artificial Sequence
  Heteroconjugate construct
DLLKNGERIEKVEGGGSTAPPAHGVSTAPPAHGV

SEQ ID NO: 1058 - protein, 35 aa, Artificial Sequence
  Heteroconjugate construct
DLLKNGERIEKVEGGGSDGSVLLNQLQVNLPHVTA

SEQ ID NO: 1059 - protein, 39 aa, Artificial Sequence
  Heteroconjugate construct
DLLKNGERIEKVEGGGGQAEPDRAHYNIVTFCCKCDSTL

SEQ ID NO: 1060 - protein, 35 aa, Artificial Sequence
  Heteroconjugate construct
DLLKNGERIEKVEGGGEVKKESTYKNENFKEYLRH

SEQ ID NO: 1061 - protein, 35 aa, Artificial Sequence
  Heteroconjugate construct
DLLKNGERIEKVEGGGKRPASSAPRTSTKKKKVKR

SEQ ID NO: 1062 - protein, 35 aa, Artificial Sequence
  Heteroconjugate construct
DLLKNGERIEKVEGGGSGSMVTSESQLFNKPYWLQ

SEQ ID NO: 1063 - protein, 38 aa, Artificial Sequence
  Heteroconjugate construct
DLLKNGERIEKVEGGGSGSYSLYGKTLEERVKKPLSEI

SEQ ID NO: 1064 - protein, 37 aa, Artificial Sequence
  Heteroconjugate construct
DLLKNGERIEKVEGGGSGSVHEIRLQCVQCKKELQRR

SEQ ID NO: 1065 - protein, 36 aa, Artificial Sequence
  Heteroconjugate construct
DLLKNGERIEKVEGGGSKPLSEILIRCIICQTPLCP

SEQ ID NO: 1066 - protein, 36 aa, Artificial Sequence
  Heteroconjugate construct
DLLKNGERIEKVEGGGPTLHEYMLDLQPETTDLYCY

SEQ ID NO: 1067 - protein, 36 aa, Artificial Sequence
  Heteroconjugate construct
DLLKNGERIEKVEGGGTWEKLLLAARAIVAIENPAD

SEQ ID NO: 1068 - protein, 35 aa, Artificial Sequence
  Heteroconjugate construct
DLLKNGERIEKVEGGGNLPTIALCNTDSPLRYVDI

SEQ ID NO: 1069 - protein, 35 aa, Artificial Sequence
  Heteroconjugate construct
DLLKNGERIEKVEGGGSIWNPILLWQPIPVHTVPL

SEQ ID NO: 1070 - protein, 35 aa, Artificial Sequence
  Heteroconjugate construct
DLLKNGERIEKVEGGGFLTPKKLQCVDLHVISNDV

SEQ ID NO: 1071 - protein, 32 aa, Artificial Sequence
  Heteroconjugate construct
DLLKNGERIEKVEGGGFLRPGDDSSHDLNLLR

SEQ ID NO: 1072 - protein, 32 aa, Artificial Sequence
  Heteroconjugate construct
DLLKNGERIEKVEGGGFQELESETLKSEEFQK

SEQ ID NO: 1073 - protein, 37 aa, Artificial Sequence
  Heteroconjugate construct
DLLKNGERIEKVEGGGGLESNVNVELLNALHSHMNKR

SEQ ID NO: 1074 - protein, 40 aa, Artificial Sequence
  Heteroconjugate construct
DLLKNGERIEKVEGGGLLKYRAREPVTKAEMLGSVVGNWQ

SEQ ID NO: 1075 - protein, 35 aa, Artificial Sequence
  Heteroconjugate construct
DLLKNGERIEKVEGGGGIELMEADPIGHLYIFATC

SEQ ID NO: 1076 - protein, 35 aa, Artificial Sequence
  Heteroconjugate construct
DLLKNGERIEKVEGGGFANCSSVYDFFVWLHYYSV

SEQ ID NO: 1077 - protein, 30 aa, Artificial Sequence
  Heteroconjugate construct
DLLKNGERIEKVEGGGMSLQRQFLRTQLWD

SEQ ID NO: 1078 - protein, 39 aa, Artificial Sequence
  Heteroconjugate construct
DLLKNGERIEKVEGGGSITKAGDFLEANYMNLQRSYTVA

SEQ ID NO: 1079 - protein, 36 aa, Artificial Sequence
  Heteroconjugate construct
DLLKNGERIEKVEGGGILLQGTPVAQMTEDAVDAER

SEQ ID NO: 1080 - protein, 26 aa, Artificial Sequence
  Heteroconjugate construct
DLLKNGERIEKVEGGGKGYTQQLAFR

SEQ ID NO: 1081 - protein, 38 aa, Artificial Sequence
  Heteroconjugate construct
DLLKNGERIEKVEGGGQLAFRQPSSAFAAFVKRAPSTW

SEQ ID NO: 1082 - protein, 32 aa, Artificial Sequence
  Heteroconjugate construct
DLLKNGERIEKVEGGGPPVVRWLNEQRYYGGG

SEQ ID NO: 1083 - protein, 40 aa, Artificial Sequence
  Heteroconjugate construct
DLLKNGERIEKVEGGGFTPTETNKAEQCCEETASSISLHG

SEQ ID NO: 1084 - protein, 39 aa, Artificial Sequence
  Heteroconjugate construct
DLLKNGERIEKVEGGGQYTGTSYDPELTESSGSASHIDC

SEQ ID NO: 1085 - protein, 33 aa, Artificial Sequence
  Heteroconjugate construct
DLLKNGERIEKVEGGGFLKKHNLNPARKYFPQW

SEQ ID NO: 1086 - protein, 35 aa, Artificial Sequence
  Heteroconjugate construct
DLLKNGERIEKVEGGGFLKKHNLNPARKYFPQWEA

SEQ ID NO: 1087 - protein, 46 aa, Artificial Sequence
  Heteroconjugate construct
DLLKNGERIEKVEGGGETKKTEDRFVPSSSKSEGKKSREQPSVLSR

SEQ ID NO: 1088 - protein, 39 aa, Artificial Sequence
  Heteroconjugate construct
DLLKNGERIEKVEGGGDAHKSEVAHRFKDLGEENFKALV

SEQ ID NO: 1089 - protein, 52 aa, Artificial Sequence
  Heteroconjugate construct
DLLKNGERIEKVEGGGSIPPEVKFNKPFVFLMIEQNTKSPLFMGKVVNPTQK

SEQ ID NO: 1090 - protein, 43 aa, Artificial Sequence
  Heteroconjugate construct
DLLKNGERIEKVEGGGSCLQQLSLLMWITQCFLPVFLAQPPSG

SEQ ID NO: 1091 - protein, 13 aa, Artificial Sequence
  Artificial variable sequence
  MISC_FEATURE (1)..(1): X is Asp or Glu
  MISC_FEATURE (2)..(3): X is Ile, Leu or Val
  MISC_FEATURE (4)..(4): X is Lys, Arg or His
  MISC_FEATURE (5)..(5): X is Asn or Gln
  MISC_FEATURE (6)..(6): X is Gly or Ala
  MISC_FEATURE (7)..(7): X is Asp or Glu
  MISC_FEATURE (8)..(8): X is Lys, Arg or His
  MISC_FEATURE (9)..(9): X is Ile, Leu or Val
  MISC_FEATURE (10)..(10): X is Asp or Glu
  misc_feature (11)..(11): Xaa is Lys, Arg or His
  MISC_FEATURE (12)..(12): X is Ile, Leu or Val
  MISC_FEATURE (13)..(13): X is Asp or Glu
XXXXXXXXXXXXX

SEQ ID NO: 1092 - protein, 4 aa, Artificial Sequence
  peptide construct
GGSG

SEQ ID NO: 1093 - protein, 5 aa, Artificial Sequence
  peptide construct
GGGGS

We claim:

1. A peptide for directing an immune response in a subject as a vaccine or to modulate immune response in an autoimmune disease or cancer, or for maturing dendritic cells, comprising a peptide construct having the formula $P_1$-x-$P_2$, wherein $P_2$ represents a specific antigenic peptide competent for recognition by a class or subclass of immune cells or binding to an antibody;

$P_1$ represents an immunomodulatory peptide which is a portion of an immunoprotein capable of promoting binding to a class or subclass of immune cells and directing a subsequent immune response to the peptide $P_2$; and x represents a covalent bond or a divalent linking group, wherein the peptide $P_2$ is derived from a cancer cell or derived from a protein involved in an autoimmune disease; and wherein the peptide construct is selected from the group consisting of SEQ ID No's: 858, 862, 877, 881, 883-884, 907-916, 966, and 1045-1090.

2. The peptide of claim 1, wherein the peptide $P_2$ is selected from the group consisting of SEQ ID No's: 963 and 1024.

3. The peptide of claim 1, wherein the peptide construct is selected from the group consisting of SEQ ID No's: 966 and 1059.

4. The peptide of claim 1, wherein the peptide $P_2$ is derived from a protein expressed by a cancer cell.

5. The peptide of claim 1, wherein the divalent linker comprises one or more glycine residues.

6. A method for targeting matured dendritic cells to a site of one or more cancer cells in a subject or a site of an autoimmune process in a subject, comprising:
contacting immature dendritic cells or monocytes with a peptide construct ex vivo under conditions suitable for maturation of the cells to form the matured dendritic cells; and
administering an effective amount of the matured dendritic cells to the subject, wherein a majority of the matured dendritic cells administered to the subject locate to the site of one or more cancer cells or the site of an autoimmune process,
wherein the matured dendritic cells are labeled with a tracking marker allowing for detection of the matured dendritic cells; and
wherein the peptide construct is the peptide of claim 1.

7. The method of claim 6, wherein the site of one or more cancer cells is detected in the subject by observing the matured dendritic cells concentrated in a location, tissue type or organ structure of the subject's body.

8. The method of claim 6, wherein the tracking marker is selected from the group consisting of a radionuclide, a luminescence dye and a fluorescent dye.

9. The method of claim 6, wherein the immature dendritic cells or monocytes are collected from the subject, and where the cells after maturation are introduced back into the subject in an autologous fashion.

10. The method of claim 6, wherein the tracing marker is conjugated to the matured dendritic cells with an antibody.

11. The method of claim 8, wherein the radionuclide is selected from the group consisting of $^{18}$F, $^{32}$P, $^{61}$Cu, $^{90}$Y, $^{99m}$Tc, 131, 125I 80O 111 $^{188}$Re, and $^{177}$Lu and the luminescence or fluorescent dye is selected from the group consisting of N, N'-di-carboxypentyl-indodicarbocyamino-5,5'-disulfonic acid (Cy5.5), Alexa Fluor probes (Alexa), carboxyfluorescein succinimidyl ester (CFSE), 4-N(S-glutathionylacetylaminophenyl)arsenoxide-Cy5.5, 2,3-dicyanonaphthalene-Cy5.5, 4-N(S-glutathionylacetylaminophenyl)arsenoxide-Alexa, 4-N(S-glutathionylacetylaminophenyl)arsenoxide-CSFE, and 2,3-dicyanonaphthalene-Alexa, and 2,3-dicyanonaphthalene-CSFE.

12. A method for delivering a therapeutic agent to a site of one or more cancer cells in a subject or to a site of an autoimmune process in a subject, comprising:
contacting immature dendritic cells or monocytes with a peptide construct ex vivo under conditions suitable for maturation of the cells to form the matured dendritic cells; and
administering an effective amount of the matured dendritic cells to the subject, wherein a majority of the matured dendritic cells administered to the subject locate to the site of one or more cancer cells or the site of an autoimmune process,
wherein the matured dendritic cells are conjugated to a therapeutic agent; and
wherein the peptide construct is the peptide of claim 1.

13. The method of claim 12, wherein the immature dendritic cells or monocytes are collected from the subject, and where the cells after maturation are introduced back into the subject in an autologous fashion.

14. The method of claim 12, wherein the therapeutic agent is conjugated to the matured dendritic cells with an antibody.

15. The method of claim 12, wherein the therapeutic agent is one or more selected from the group consisting of monomethyl auristatin E (MMAE), ozogamicin, emtansine, gelonin, staphylococcal enterotoxin B (SEB) superantigen, Saporin, interferon-α, a microtubule inhibitor, an antimitotic agent, a maytansinoid, a receptor tyrosine kinase inhibitor, and a phosphoinositide 3-kinase inhibitor.

16. The method of claim 12, wherein the peptide construct is conjugated to the therapeutic agent.

17. A method for vaccinating a subject, comprising:
administering an effective amount of a peptide construct optionally with an adjuvant to the subject or administering an effective amount of matured dendritic cells to the subject, wherein the peptide construct is the peptide of claim 1; and
the matured dendritic cells are formed by contacting immature dendritic cells or monocytes with the peptide construct under conditions suitable for maturation of the cells to form matured dendritic cells,
wherein the peptide constructor the matured dendritic cells are administered to the subject prophylactically.

18. The method of claim 17, wherein the immature dendritic cells or monocytes are collected from the subject, and where the cells after maturation are introduced back into the subject in an autologous fashion.

19. The method of claim 17, wherein the peptide $P_2$ is selected from the group consisting of SEQ ID No's: 963 and 1024.

20. The method of claim 17, wherein the peptide construct is administered with an adjuvant that is selected from the group consisting of Freund's incomplete adjuvant, a liposomal adjuvant, a water-in-oil formulation, and a water-in-oil-in-water formulation.

21. A method of modulating an immune response in a subject, comprising: administering an effective amount of a peptide construct optionally with an adjuvant to the subject or administering an effective amount of matured dendritic cells to the subject, wherein the peptide construct is the peptide of claim 1; and
the matured dendritic cells are formed by contacting immature dendritic cells or monocytes with the peptide construct under conditions suitable for maturation of the cells to form matured dendritic cells,
wherein the peptide constructor the matured dendritic cells are administered to the subject having an autoimmune disease or condition.

22. The method of claim 21, wherein the immature dendritic cells or monocytes are collected from the subject, and where the cells after maturation are introduced back into the subject in an autologous fashion.

* * * * *